US007772188B2

(12) United States Patent
Currie et al.

(10) Patent No.: US 7,772,188 B2
(45) Date of Patent: Aug. 10, 2010

(54) METHODS AND COMPOSITIONS FOR THE TREATMENT OF GASTROINTESTINAL DISORDERS

(75) Inventors: Mark G. Currie, Sterling, MA (US); Shalina Mahajan-Miklos, Palo Alto, CA (US); Angelika Fretzen, Somerville, MA (US); Li Jing Sun, New York, NY (US); Caroline Kurtz, Sudbury, MA (US); Thea Norman, San Diego, CA (US); G. Todd Milne, Brookline, MA (US)

(73) Assignee: Ironwood Pharmaceuticals, Inc., Cambridge, MA (US)

( * ) Notice: Subject to any disclaimer, the term of this patent is extended or adjusted under 35 U.S.C. 154(b) by 1498 days.

(21) Appl. No.: 11/054,071

(22) Filed: Feb. 8, 2005

(65) Prior Publication Data

US 2009/0062207 A1    Mar. 5, 2009

Related U.S. Application Data

(63) Continuation-in-part of application No. 10/899,806, filed on Jul. 27, 2004, now Pat. No. 7,371,727, which is a continuation-in-part of application No. 10/845,895, filed on May 14, 2004, now abandoned, which is a continuation-in-part of application No. 10/796,719, filed on Mar. 9, 2004, now Pat. No. 7,304,036, which is a continuation-in-part of application No. 10/766,735, filed on Jan. 28, 2004, now abandoned.

(60) Provisional application No. 60/443,098, filed on Jan. 28, 2003, provisional application No. 60/471,288, filed on May 15, 2003, provisional application No. 60/519,460, filed on Nov. 12, 2003.

(51) Int. Cl.
*A61K 38/10* (2006.01)
(52) U.S. Cl. .................. 514/14; 435/320.1; 435/325; 530/327; 530/333
(58) Field of Classification Search .................. None
See application file for complete search history.

(56) References Cited

U.S. PATENT DOCUMENTS

| 5,140,102 | A | 8/1992 | Currie ........................ 530/326 |
| 5,395,490 | A | 3/1995 | Hoff .......................... 204/132 |
| 5,489,670 | A | 2/1996 | Currie et al. ................ 530/326 |
| 5,969,097 | A | 10/1999 | Wiegand et al. ............. 530/326 |
| 6,060,037 | A | 5/2000 | Waldman .................... 424/1.65 |
| 7,304,036 | B2 | 12/2007 | Currie et al. |
| 7,371,727 | B2 | 5/2008 | Currie et al. |
| 2003/0073628 | A1 | 4/2003 | Shailubhai et al. ............ 514/12 |
| 2003/0232013 | A1 | 12/2003 | Siechman et al. ........... 424/1.69 |
| 2004/0121961 | A1 | 6/2004 | Masferrer ..................... 514/15 |
| 2004/0152868 | A1 | 8/2004 | Larsen et al. ................ 530/317 |
| 2004/0258687 | A1 | 12/2004 | Waldman et al. .......... 424/143.1 |
| 2004/0266989 | A1 | 12/2004 | Currie et al. ................ 530/326 |
| 2005/0020811 | A1 | 1/2005 | Currie et al. |
| 2005/0032684 | A1 | 2/2005 | Cetin et al. ................... 514/12 |
| 2006/0258593 | A1 | 11/2006 | Currie et al. |
| 2006/0281682 | A1 | 12/2006 | Currie et al. |
| 2008/0227685 | A1 | 9/2008 | Currie et al. |
| 2009/0005534 | A1 | 1/2009 | Currie et al. |
| 2009/0191611 | A1 | 7/2009 | Currie et al. |

FOREIGN PATENT DOCUMENTS

| EP | 1012188 | 6/2000 |
| WO | WO 99/14239 | 3/1999 |
| WO | WO 01/25266 | 4/2001 |
| WO | WO 02/062369 | 8/2002 |
| WO | WO 02/078683 | 10/2002 |
| WO | WO 02/079235 | 10/2002 |
| WO | WO 02/098912 | 12/2002 |
| WO | WO 03/072125 | 9/2003 |
| WO | WO03072754 A2 | 9/2003 |
| WO | WO2004/069165 | 8/2004 |
| WO | WO 2004/071436 | 8/2004 |
| WO | WO2005/087797 | 9/2005 |

OTHER PUBLICATIONS

Amarante et al., "The κ-opioid agonist (±)-bremazocine elicits peripheral antinociception by activation of the L-arginine/nitric oxide/cyclic GMP pathway" *European Journal of Pharmacology*, vol. 454: pp. 19-23 (2002).
Arita et al., "Purification and characterization of a heat-stable enterotoxin of *Vibrio mimicus*" *FEMS Microbiology Letters*, vol. 79/1: pp. 105-110 (1991).
Chan et al., "Amino Acid Sequence of Heat-stable Enterotoxin Produced by *Escherichia coli* Pathogenic for Man" *The Journal of Biological Chemistry*, vol. 256, No. 15: pp. 7744-7746 (1981).
Forte et al., "Lymphoguanylin: Cloning and Characterization of a Unique Member of the Guanylin Peptide Family" *Endocrinology*, vol. 140, No. 4: pp. 1800-1806 (1999).

(Continued)

*Primary Examiner*—Christopher R. Tate
*Assistant Examiner*—Roy Teller
(74) *Attorney, Agent, or Firm*—Honigman Miller Schwartz and Cohn; Kelly T. Murphy; Jonathan P. O'Brien

(57) ABSTRACT

The present invention features compositions and related methods for treating IBS and other gastrointestinal disorders and conditions (e.g., gastrointestinal motility disorders, functional gastrointestinal disorders, gastroesophageal reflux disease (GERD), duodenogastric reflux, Crohn's disease, ulcerative colitis, Inflammatory bowel disease, functional heartburn, dyspepsia (including functional dyspepsia or non-ulcer dyspepsia), gastroparesis, chronic intestinal pseudo-obstruction (or colonic pseudo-obstruction), and disorders and conditions associated with constipation, e.g., constipation associated with use of opiate pain killers, post-surgical constipation (post-operative ileus), and constipation associated with neuropathic disorders as well as other conditions and disorders using peptides and other agents that activate the guanylate cyclase C (GC-C) receptor.

10 Claims, 69 Drawing Sheets

OTHER PUBLICATIONS

Giannela, "*Escherichia coli* heat-stable enterotoxins, guanylins, and their receptors: What are they and what do they do?" *The Journal of Laboratory and Clinical Medicine*, vol. 125, No. 2: pp. 173-181 (1995).

Gualillo et al., "Ghrelin, a widespread hormone: insights into molecular and cellular regulation of its expression and mechanism of action" *FEBS Letters*, vol. 552: pp. 105-109 (2003).

Guarino et al., "*Citrobacter freundii* Produces an 18-Amino-Acid Heat-Stable Enterotoxin Identical to the 18-Amino-Acid *Escherichia coli* Heat-Stable Enterotoxin (ST Ia)" *Infection and Immunity*, vol. 57, No. 2: pp. 649-652 (1989).

Huang et al., "Nucleotide sequence of a gene encoding the novel *Yersinia enterocolitica* heat-stable enterotoxin that includes a pro-region-like sequence in its mature toxin molecule" *Microbial Pathogenesis*, vol. 22: pp. 89-97 (1997).

Jain et al., "Sildenafil-induced peripheral analgesia and activation of the nitric oxide-cyclic GMP pathway" *Brain Research*, vol. 909: pp. 170-178 (2001).

Kim et al., "Changes in ghrelin and ghrelin receptor expression according to feeding status" *NeuroReport*, vol. 14, No. 10: pp. 1317-1320 (2003).

Lazaro-Ibanez et al., "Participation of the nitric oxide-cyclic GMP-ATP-sensitive $K^+$ channel pathway in the antinociceptive action of ketorolac" *European Journal of Pharmacology*, vol. 426: pp. 39-44 (2001).

Moseley et al., "Isolation and Nucleotide Sequence Determination of a Gene Encoding a Heat-Stable Enterotoxin of *Escherichia coli*" *Infection and Immunity*, vol. 39, No. 3: pp. 1167-1174 (1983).

Nzegwu et al., "Luminal capsaicin inhibits fluid secretion induced by exterotoxin *E. coli* STa, but not by carbachol, in vivo in rat small and large intestines" *Experimental Physiology*, vol. 81, No. 2: pp. 313-315 (1996).

Rolfe et al., "Enterotoxin *Escherichia coli* STa activates a nitric oxide-dependent myenteric plexus secretory reflex in the rat ileum" *The Journal of Physiology*, vol. 475, No. 3: pp. 531-537 (1994).

Rolfe et al., "Vagotomy inhibits the jejunal fluid secretion activated by luminal ileal *Escherichia coli* STa in the rat in vivo" *GUT*, vol. 44: pp. 615-619 (1999).

Shailubhai, "Therapeutic applications of guanylate cyclase-C receptor agonists" *Drug Discovery & Development*, vol. 5 No. 2: pp. 261-268 (2002).

So et al., "Nucleotide Sequence of the Bacterial Transposon Tn1681 Encoding a Heat-Stable (ST) Toxin and Its Identification in Enterotoxigenic *Escherichia coli* Strains" *Proceedings of the National Academy of Sciences of the U.S.A.*, vol. 77, No. 7 [Part 2: Biological Sciences]: pp. 4011-4015 (1980).

Soares, et al., "Dibutyryl-cyclic GMP induces peripheral antinociception via activation of ATP-sensitive $K^+$ channels in the RAT $PGE_2$-induced hyperalgesic paw" *British Journal of Pharmacology*, vol. 134: pp. 127-131 (2001).

Takao et al., "Amino acid sequence of heat-stable enterotoxin produced by *Vibrio cholerae* non-01" *FEBS*), vol. 193, No. 2: pp. 250-254 (1985).

Takao et al., "Isolation, primary structure and synthesis of heat-stable enterotoxin produced by *Yersinia enterocolitica*" *European Journal of Biochemistry*, vol. 152, No. 1: pp. 199-206 (1985).

Vaandrager et al., "Structure and function of the heat-stable enterotoxin receptor/guanylyl cyclase C" *Molecular and Cellular Biochemistry*, vol. 230, Nos. 1&2: pp. 73-83 (2002).

GenBank Accession No. QHECIB; GI:69638; Aimoto et al., Jun. 18, 1999.
GenBank Accession No. P01559; GI:123711; So et al., Oct. 25, 2004.
GenBank Accession No. AAA24653; GI:147878; Sekizaki et al., Apr. 26, 1993.
GenBank Accession No. P01560; GI:123707; Chan et al., Jun. 15, 2004.
GenBank Accession No. AAA27561; GI:295439; Ogawa et al., Jun. 12, 1993.
GenBank Accession No. P04429; GI:123712; Ogawa et al., Jun. 15, 2004.
GenBank Accession No. S34671; GI:421286; Rossolini et al., Apr. 12, 1995.
GenBank Accession No. CAA52209; GI:395161; Guglielmetti et al., Jul. 27, 2995.
GenBank Accession No. A54534; GI:628844; Arita et al., May 3, 1996.
GenBank Accession No. AAL02159; GI:15592919; Teixeira et al., Sep. 13, 2001.
GenBank Accession No. AAA18472; GI:487395; Mikulskis et al., May 26, 1994.
GenBank Accession No. S25659; GI:282047; Takao et al., Oct. 15, 1999.
GenBank Accession No. P74977; GI:3913874; Ramamurthy et al., Jun. 15, 2004.
GenBank Accession No. BAA23656; GI:2662339; Huang et al., Feb. 13, 1999.
GenBank Accession No. P31518; GI:399947; Ibrahim et al., Mar. 15, 2004.
GenBank Accession No. P07965; GI:3915589; Stieglitz et al., Jun. 15, 2004.

Camilleri, "Management of the Irritable Bowel Syndrome" Gastroenterology 120:652-668, 2001.

Drossman, D.A., "The functional gastrointestinal disorders and the Rome II process" Gut 45:Supp. II:111-113, 1999.

Drossman, D.A., "Psychosocial aspects of the functional gastrointestinal disorders" Gut 45:Supp. II:1125-1130, 1999.

Drossman et al., "U.S. Householder Survey of Functional Gastrointestinal Disorders" Digestive Diseases and Sciences 38(9):1569-1580, 1993.

Ringel, et al., "Irritable Bowel Syndrome" Annu. Rev. Med. 52:319-38, 2001.

Santos-Neto, et al., "Guanylin and its Lysine-Containing Analogue in the Isolated Perfused Rat Kideny" Pharmacol. & Toxicol. 92:114-120, 2003.

Talley, et al., "Irritable Bowel Syndrome in a Community: Symptom Subgroups, Risk.." Am. J. of Epidemiology 142(1):76-83, 1995.

Talley, et al., "Medical Costs in Community Subjects with Irritable Bowel Syndrome" Gastroenterology 109(6):1736-1741, 1995.

Abandonment for U.S. Appl. No. 10/766,735 dated Nov. 28, 2007.

Abandonment for U.S. Appl. No. 10/845,895 dated Mar. 9, 2009.

Notice of Allowance for U.S. Appl. No. 11/930,696 dated Aug. 7, 2009.

Notice of Allowance for U.S. Appl. No. 11/949,340 dated Nov. 3, 2009.

Forte, L.,"Uroguanylin and guanylin peptides; pharmacology and experimental therapeutics", Pharmacology & Therapeutics, vol. 104, (2004), pp. 137-162.

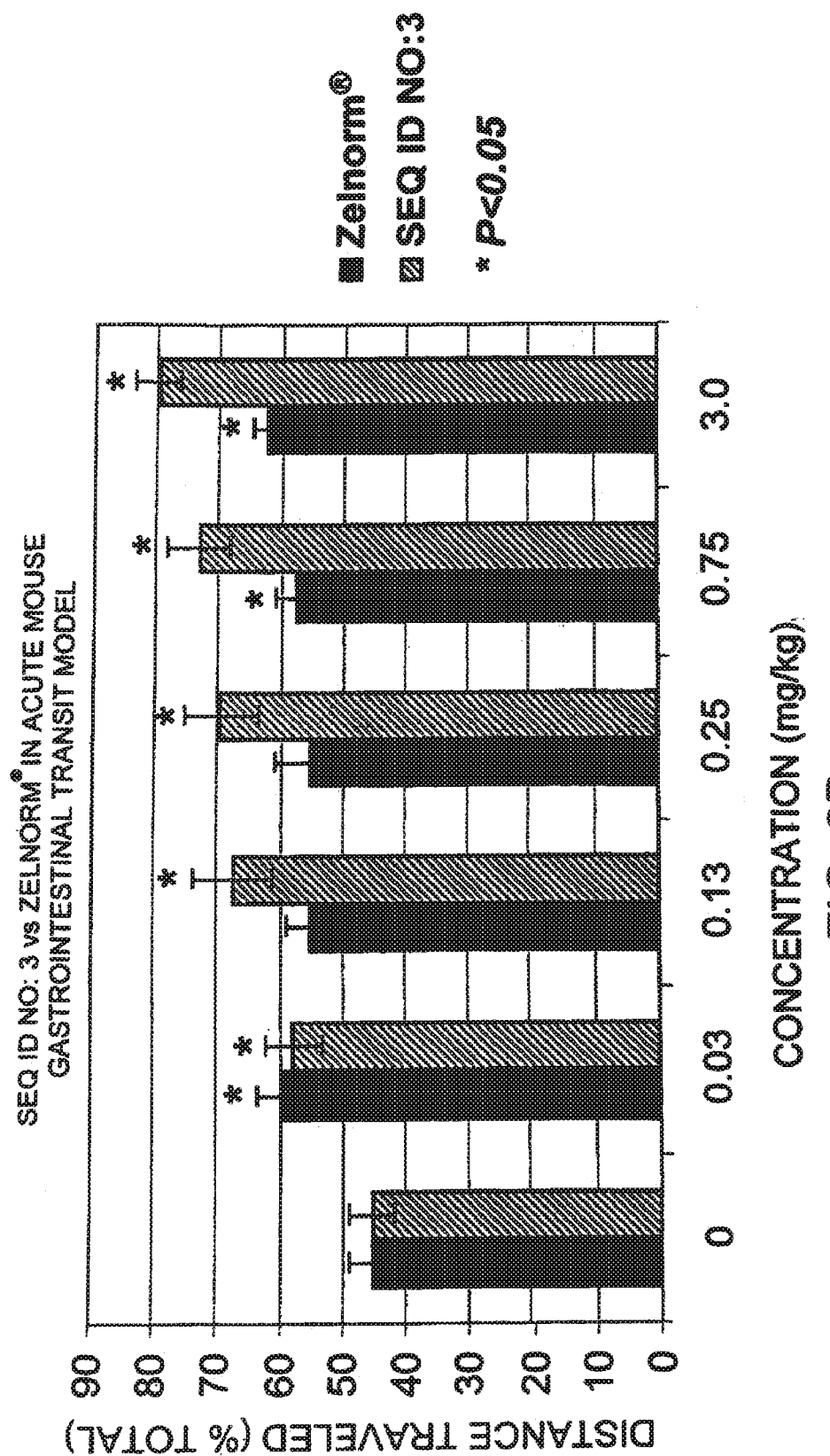

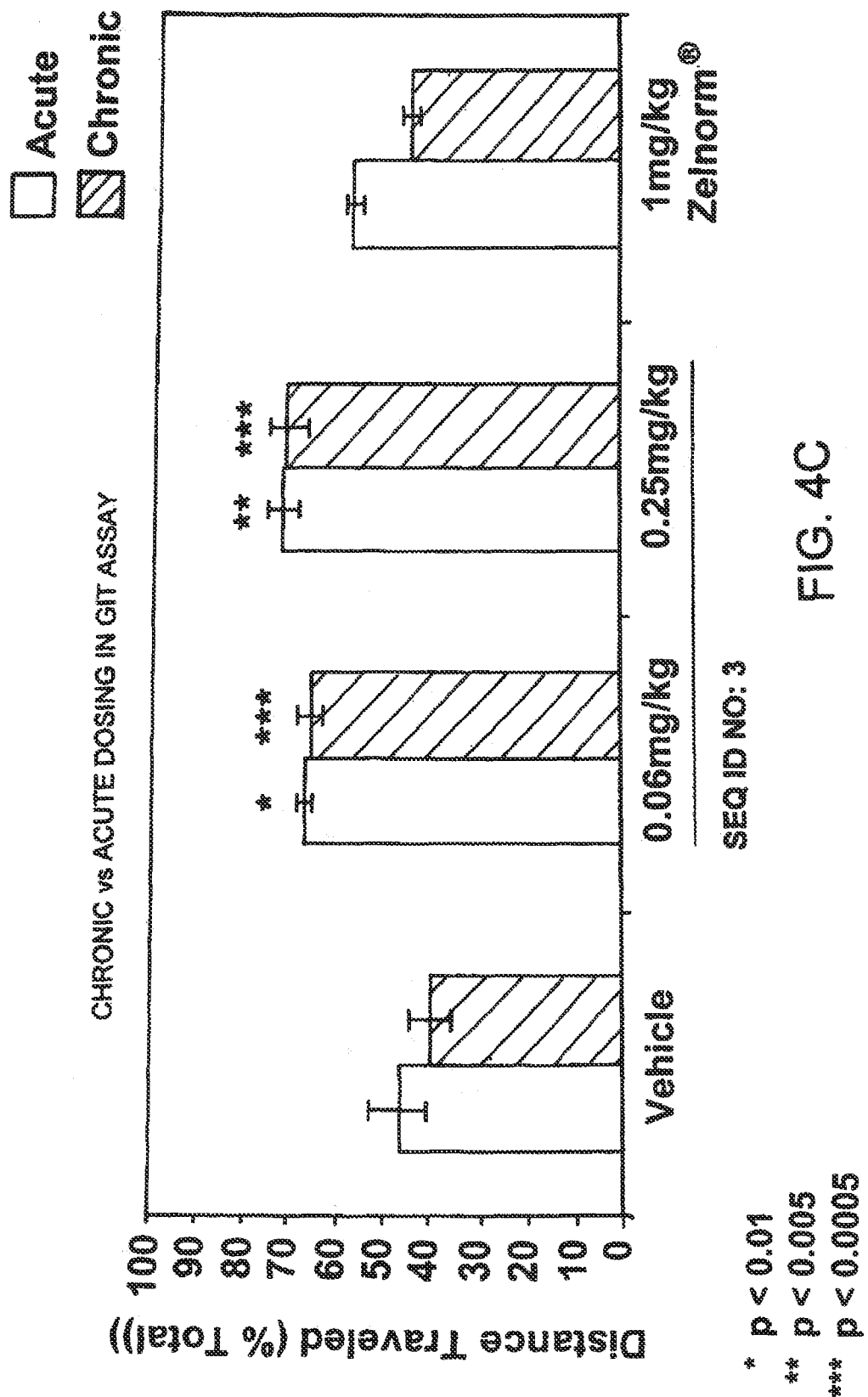

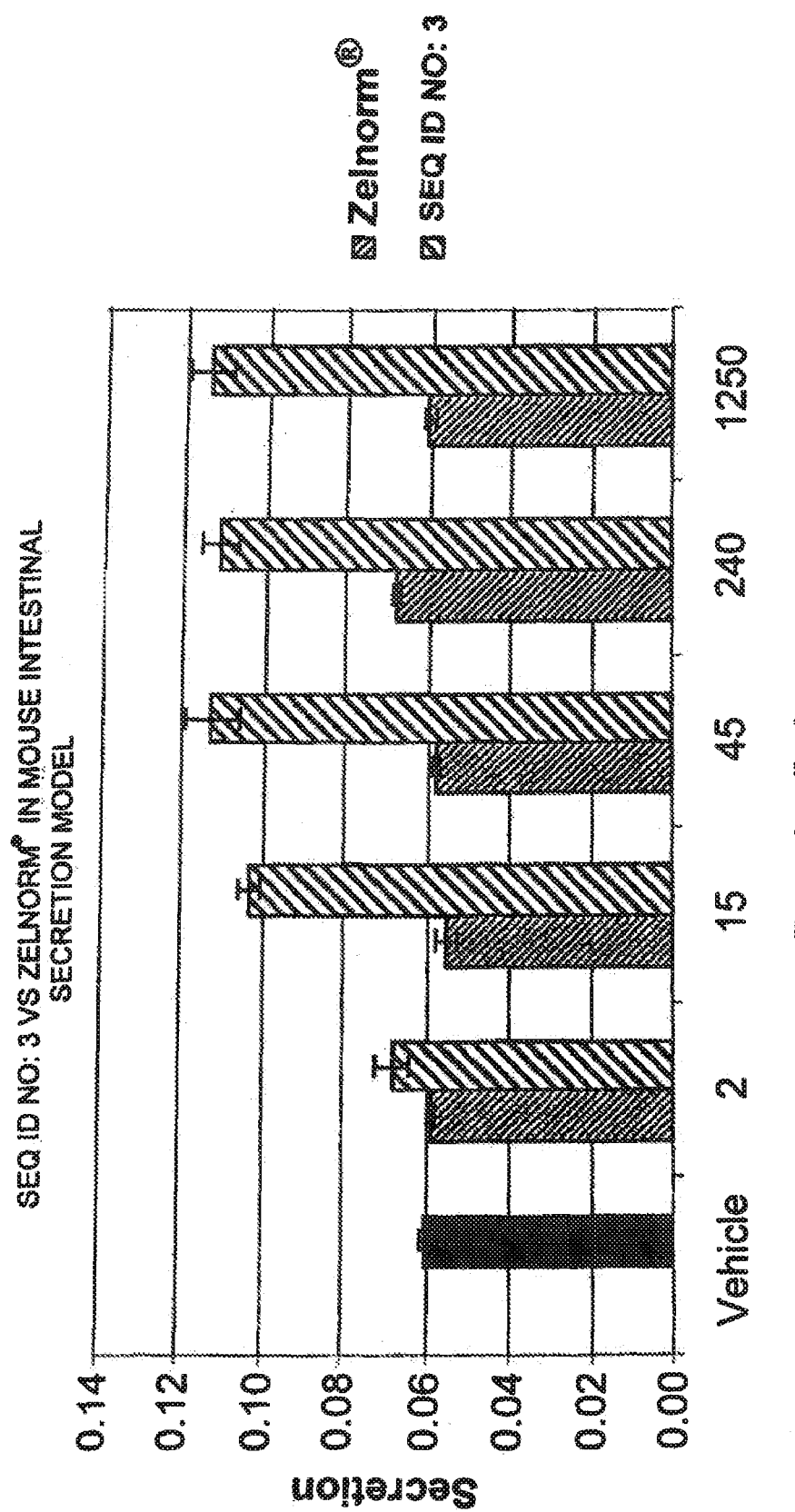

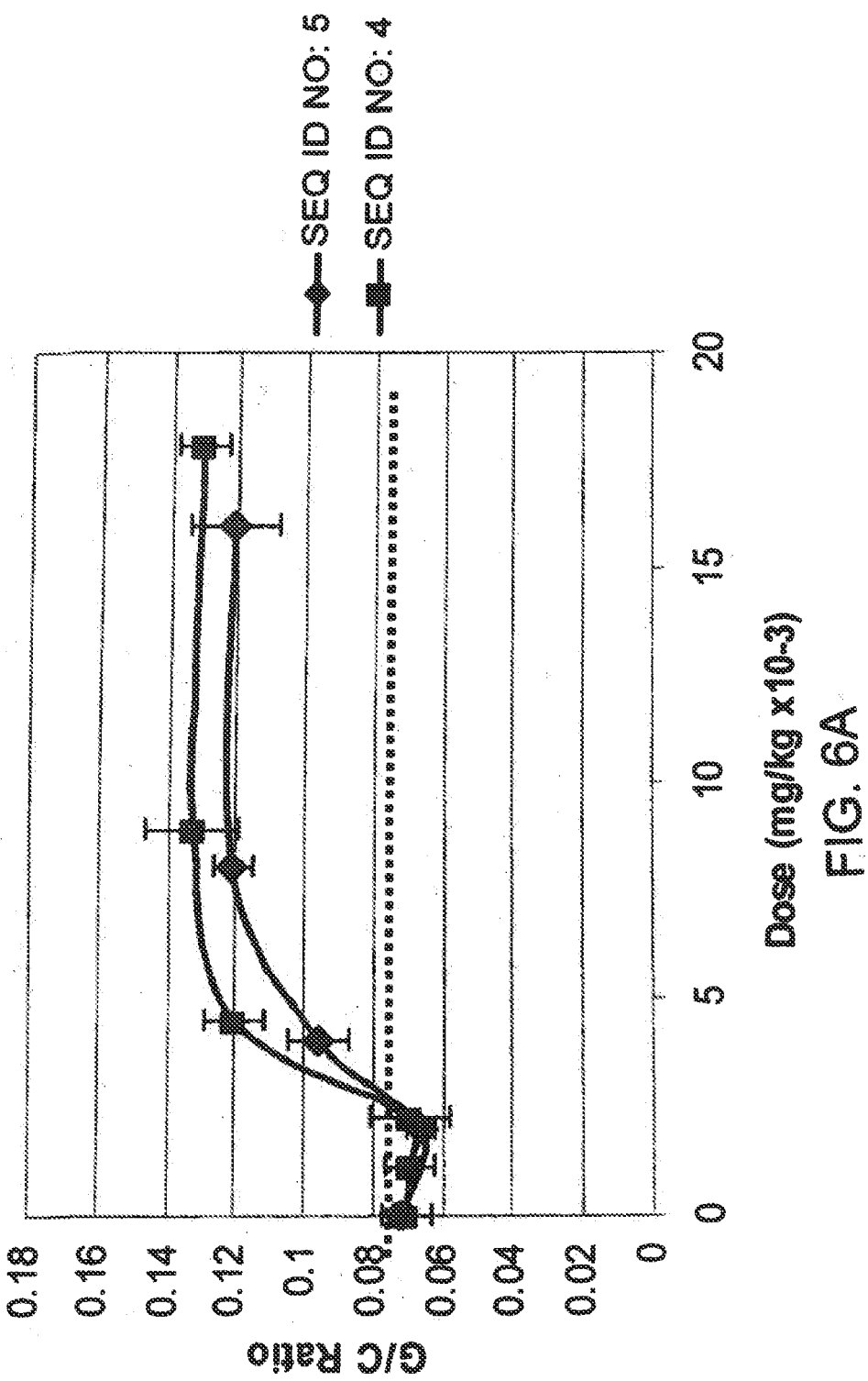

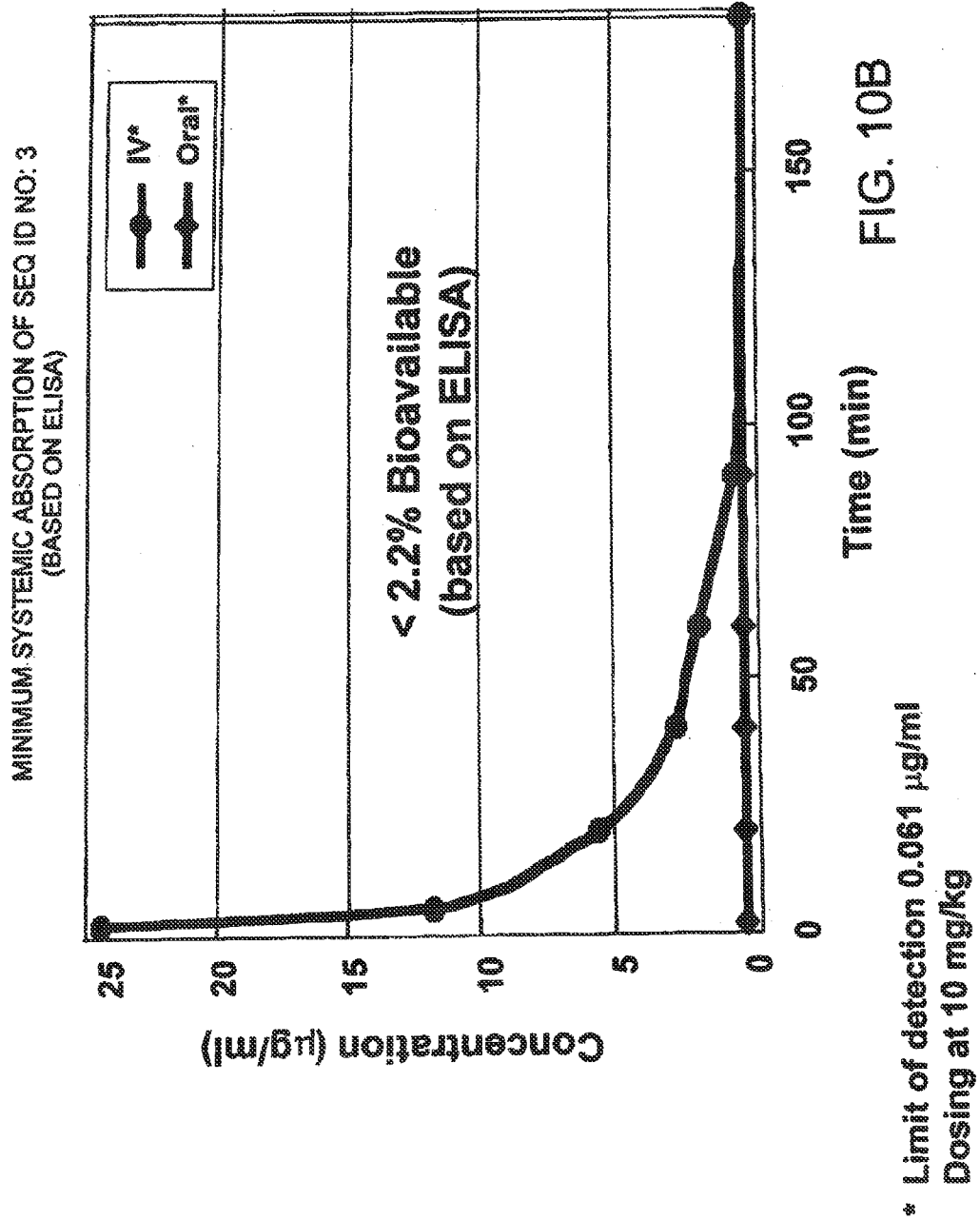

| | | | | | | | | | | | | |
|---|---|---|---|---|---|---|---|---|---|---|---|---|
| Cys | Cys | Glu | Tyr | Cys | Cys | Asn | Pro | Ala | Cys | Thr | Gly | Cys | Tyr | (SEQ ID NO:3) |

| | | | | | | | | | | | | | |
|---|---|---|---|---|---|---|---|---|---|---|---|---|---|
| Cys | Cys | --- | Tyr | Cys | Cys | Asn | Pro | Ala | Cys | Thr | Gly | Cys | Tyr | (SEQ ID NO:130) |
| Cys | Cys | --- | --- | Cys | Cys | Asn | Pro | Ala | Cys | Thr | Gly | Cys | Tyr | (SEQ ID NO:131) |
| Cys | Cys | --- | --- | Cys | Cys | --- | Pro | Ala | Cys | Thr | Gly | Cys | Tyr | (SEQ ID NO:132) |
| Cys | Cys | --- | --- | Cys | Cys | --- | --- | Ala | Cys | Thr | Gly | Cys | Tyr | (SEQ ID NO:133) |
| Cys | Cys | --- | --- | Cys | Cys | --- | Pro | --- | Cys | Thr | Gly | Cys | Tyr | (SEQ ID NO:134) |
| Cys | Cys | --- | --- | Cys | Cys | --- | Pro | Ala | Cys | --- | Gly | Cys | Tyr | (SEQ ID NO:135) |
| Cys | Cys | --- | --- | Cys | Cys | --- | Pro | Ala | Cys | Thr | --- | Cys | Tyr | (SEQ ID NO:136) |
| Cys | Cys | --- | --- | Cys | Cys | --- | Pro | Ala | Cys | Thr | Gly | Cys | --- | (SEQ ID NO:137) |
| Cys | Cys | --- | --- | Cys | Cys | Asn | --- | Ala | Cys | Thr | Gly | Cys | Tyr | (SEQ ID NO:138) |
| Cys | Cys | --- | --- | Cys | Cys | Asn | --- | --- | Cys | Thr | Gly | Cys | Tyr | (SEQ ID NO:139) |
| Cys | Cys | --- | --- | Cys | Cys | Asn | --- | Ala | Cys | --- | Gly | Cys | Tyr | (SEQ ID NO:140) |
| Cys | Cys | --- | --- | Cys | Cys | Asn | --- | Ala | Cys | Thr | --- | Cys | Tyr | (SEQ ID NO:141) |
| Cys | Cys | --- | --- | Cys | Cys | Asn | --- | Ala | Cys | Thr | Gly | Cys | --- | (SEQ ID NO:142) |
| Cys | Cys | --- | --- | Cys | Cys | Asn | Pro | --- | Cys | Thr | Gly | Cys | Tyr | (SEQ ID NO:143) |
| Cys | Cys | --- | --- | Cys | Cys | Asn | Pro | --- | Cys | --- | Gly | Cys | Tyr | (SEQ ID NO:144) |
| Cys | Cys | --- | --- | Cys | Cys | Asn | Pro | --- | Cys | Thr | --- | Cys | Tyr | (SEQ ID NO:145) |
| Cys | Cys | --- | --- | Cys | Cys | Asn | Pro | --- | Cys | Thr | Gly | Cys | --- | (SEQ ID NO:146) |
| Cys | Cys | --- | --- | Cys | Cys | Asn | Pro | Ala | Cys | --- | Gly | Cys | Tyr | (SEQ ID NO:147) |
| Cys | Cys | --- | --- | Cys | Cys | Asn | Pro | Ala | Cys | --- | --- | Cys | Tyr | (SEQ ID NO:148) |
| Cys | Cys | --- | --- | Cys | Cys | Asn | Pro | Ala | Cys | --- | Gly | Cys | --- | (SEQ ID NO:149) |
| Cys | Cys | --- | --- | Cys | Cys | Asn | Pro | Ala | Cys | Thr | --- | Cys | Tyr | (SEQ ID NO:150) |
| Cys | Cys | --- | --- | Cys | Cys | Asn | Pro | Ala | Cys | Thr | --- | Cys | --- | (SEQ ID NO:151) |
| Cys | Cys | --- | --- | Cys | Cys | Asn | Pro | Ala | Cys | Thr | Gly | Cys | --- | (SEQ ID NO:152) |
| Cys | Cys | --- | Tyr | Cys | Cys | --- | Pro | Ala | Cys | Thr | Gly | Cys | Tyr | (SEQ ID NO:153) |
| Cys | Cys | --- | Tyr | Cys | Cys | --- | --- | Ala | Cys | Thr | Gly | Cys | Tyr | (SEQ ID NO:154) |
| Cys | Cys | --- | Tyr | Cys | Cys | --- | --- | --- | Cys | Thr | Gly | Cys | Tyr | (SEQ ID NO:155) |
| Cys | Cys | --- | Tyr | Cys | Cys | --- | --- | Ala | Cys | --- | Gly | Cys | Tyr | (SEQ ID NO:156) |
| Cys | Cys | --- | Tyr | Cys | Cys | --- | --- | Ala | Cys | Thr | --- | Cys | Tyr | (SEQ ID NO:157) |
| Cys | Cys | --- | Tyr | Cys | Cys | --- | --- | Ala | Cys | Thr | Gly | Cys | --- | (SEQ ID NO:158) |
| Cys | Cys | --- | Tyr | Cys | Cys | --- | Pro | --- | Cys | Thr | Gly | Cys | Tyr | (SEQ ID NO:159) |
| Cys | Cys | --- | Tyr | Cys | Cys | --- | Pro | --- | Cys | --- | Gly | Cys | Tyr | (SEQ ID NO:160) |
| Cys | Cys | --- | Tyr | Cys | Cys | --- | Pro | --- | Cys | Thr | --- | Cys | Tyr | (SEQ ID NO:161) |
| Cys | Cys | --- | Tyr | Cys | Cys | --- | Pro | --- | Cys | Thr | Gly | Cys | --- | (SEQ ID NO:162) |
| Cys | Cys | --- | Tyr | Cys | Cys | --- | Pro | Ala | Cys | --- | Gly | Cys | Tyr | (SEQ ID NO:163) |
| Cys | Cys | --- | Tyr | Cys | Cys | --- | Pro | Ala | Cys | --- | --- | Cys | Tyr | (SEQ ID NO:164) |
| Cys | Cys | --- | Tyr | Cys | Cys | --- | Pro | Ala | Cys | --- | Gly | Cys | --- | (SEQ ID NO:165) |
| Cys | Cys | --- | Tyr | Cys | Cys | --- | Pro | Ala | Cys | Thr | --- | Cys | Tyr | (SEQ ID NO:166) |
| Cys | Cys | --- | Tyr | Cys | Cys | --- | Pro | Ala | Cys | Thr | --- | Cys | --- | (SEQ ID NO:167) |
| Cys | Cys | --- | Tyr | Cys | Cys | --- | Pro | Ala | Cys | Thr | Gly | Cys | --- | (SEQ ID NO:168) |
| Cys | Cys | --- | Tyr | Cys | Cys | Asn | --- | Ala | Cys | Thr | Gly | Cys | Tyr | (SEQ ID NO:169) |
| Cys | Cys | --- | Tyr | Cys | Cys | Asn | --- | --- | Cys | Thr | Gly | Cys | Tyr | (SEQ ID NO:170) |
| Cys | Cys | --- | Tyr | Cys | Cys | Asn | --- | --- | Cys | --- | Gly | Cys | Tyr | (SEQ ID NO:171) |
| Cys | Cys | --- | Tyr | Cys | Cys | Asn | --- | --- | Cys | Thr | --- | Cys | Tyr | (SEQ ID NO:172) |

FIG. 11-1

| | | | | | | | | | | | | |
|---|---|---|---|---|---|---|---|---|---|---|---|---|
| Cys | Cys | --- | Tyr | Cys | Cys | Asn | --- | --- | Cys | Thr | Gly | Cys | --- | (SEQ ID NO:173) |
| Cys | Cys | --- | Tyr | Cys | Cys | Asn | --- | Ala | Cys | --- | Gly | Cys | Tyr | (SEQ ID NO:174) |
| Cys | Cys | --- | Tyr | Cys | Cys | Asn | --- | Ala | Cys | --- | --- | Cys | Tyr | (SEQ ID NO:175) |
| Cys | Cys | --- | Tyr | Cys | Cys | Asn | --- | Ala | Cys | --- | Gly | Cys | --- | (SEQ ID NO:176) |
| Cys | Cys | --- | Tyr | Cys | Cys | Asn | --- | Ala | Cys | Thr | --- | Cys | Tyr | (SEQ ID NO:177) |
| Cys | Cys | --- | Tyr | Cys | Cys | Asn | --- | Ala | Cys | Thr | --- | Cys | --- | (SEQ ID NO:178) |
| Cys | Cys | --- | Tyr | Cys | Cys | Asn | --- | Ala | Cys | Thr | Gly | Cys | --- | (SEQ ID NO:179) |
| Cys | Cys | --- | Tyr | Cys | Cys | Asn | Pro | --- | Cys | Thr | Gly | Cys | Tyr | (SEQ ID NO:180) |
| Cys | Cys | --- | Tyr | Cys | Cys | Asn | Pro | --- | Cys | --- | Gly | Cys | Tyr | (SEQ ID NO:181) |
| Cys | Cys | --- | Tyr | Cys | Cys | Asn | Pro | --- | Cys | --- | --- | Cys | Tyr | (SEQ ID NO:182) |
| Cys | Cys | --- | Tyr | Cys | Cys | Asn | Pro | --- | Cys | --- | Gly | Cys | --- | (SEQ ID NO:183) |
| Cys | Cys | --- | Tyr | Cys | Cys | Asn | Pro | --- | Cys | Thr | --- | Cys | Tyr | (SEQ ID NO:184) |
| Cys | Cys | --- | Tyr | Cys | Cys | Asn | Pro | --- | Cys | Thr | --- | Cys | --- | (SEQ ID NO:185) |
| Cys | Cys | --- | Tyr | Cys | Cys | Asn | Pro | --- | Cys | Thr | Gly | Cys | --- | (SEQ ID NO:186) |
| Cys | Cys | --- | Tyr | Cys | Cys | Asn | Pro | Ala | Cys | --- | Gly | Cys | Tyr | (SEQ ID NO:187) |
| Cys | Cys | --- | Tyr | Cys | Cys | Asn | Pro | Ala | Cys | --- | --- | Cys | Tyr | (SEQ ID NO:188) |
| Cys | Cys | --- | Tyr | Cys | Cys | Asn | Pro | Ala | Cys | --- | --- | Cys | --- | (SEQ ID NO:189) |
| Cys | Cys | --- | Tyr | Cys | Cys | Asn | Pro | Ala | Cys | --- | Gly | Cys | --- | (SEQ ID NO:190) |
| Cys | Cys | --- | Tyr | Cys | Cys | Asn | Pro | Ala | Cys | Thr | --- | Cys | Tyr | (SEQ ID NO:191) |
| Cys | Cys | --- | Tyr | Cys | Cys | Asn | Pro | Ala | Cys | Thr | --- | Cys | --- | (SEQ ID NO:192) |
| Cys | Cys | --- | Tyr | Cys | Cys | Asn | Pro | Ala | Cys | Thr | Gly | Cys | --- | (SEQ ID NO:193) |
| Cys | Cys | Glu | --- | Cys | Cys | Asn | Pro | Ala | Cys | Thr | Gly | Cys | Tyr | (SEQ ID NO:194) |
| Cys | Cys | Glu | --- | Cys | Cys | --- | Pro | Ala | Cys | Thr | Gly | Cys | Tyr | (SEQ ID NO:195) |
| Cys | Cys | Glu | --- | Cys | Cys | --- | --- | Ala | Cys | Thr | Gly | Cys | Tyr | (SEQ ID NO:196) |
| Cys | Cys | Glu | --- | Cys | Cys | --- | --- | --- | Cys | Thr | Gly | Cys | Tyr | (SEQ ID NO:197) |
| Cys | Cys | Glu | --- | Cys | Cys | --- | --- | Ala | Cys | --- | Gly | Cys | Tyr | (SEQ ID NO:198) |
| Cys | Cys | Glu | --- | Cys | Cys | --- | --- | Ala | Cys | Thr | --- | Cys | Tyr | (SEQ ID NO:199) |
| Cys | Cys | Glu | --- | Cys | Cys | --- | --- | Ala | Cys | Thr | Gly | Cys | --- | (SEQ ID NO:200) |
| Cys | Cys | Glu | --- | Cys | Cys | --- | Pro | --- | Cys | Thr | Gly | Cys | Tyr | (SEQ ID NO:201) |
| Cys | Cys | Glu | --- | Cys | Cys | --- | Pro | --- | Cys | --- | Gly | Cys | Tyr | (SEQ ID NO:202) |
| Cys | Cys | Glu | --- | Cys | Cys | --- | Pro | --- | Cys | Thr | --- | Cys | Tyr | (SEQ ID NO:203) |
| Cys | Cys | Glu | --- | Cys | Cys | --- | Pro | --- | Cys | Thr | Gly | Cys | --- | (SEQ ID NO:204) |
| Cys | Cys | Glu | --- | Cys | Cys | --- | Pro | Ala | Cys | --- | Gly | Cys | Tyr | (SEQ ID NO:205) |
| Cys | Cys | Glu | --- | Cys | Cys | --- | Pro | Ala | Cys | --- | --- | Cys | Tyr | (SEQ ID NO:206) |
| Cys | Cys | Glu | --- | Cys | Cys | --- | Pro | Ala | Cys | --- | Gly | Cys | --- | (SEQ ID NO:207) |
| Cys | Cys | Glu | --- | Cys | Cys | --- | Pro | Ala | Cys | Thr | --- | Cys | Tyr | (SEQ ID NO:208) |
| Cys | Cys | Glu | --- | Cys | Cys | --- | Pro | Ala | Cys | Thr | --- | Cys | --- | (SEQ ID NO:209) |
| Cys | Cys | Glu | --- | Cys | Cys | --- | Pro | Ala | Cys | Thr | Gly | Cys | --- | (SEQ ID NO:210) |
| Cys | Cys | Glu | --- | Cys | Cys | Asn | --- | Ala | Cys | Thr | Gly | Cys | Tyr | (SEQ ID NO:211) |
| Cys | Cys | Glu | --- | Cys | Cys | Asn | --- | --- | Cys | Thr | Gly | Cys | Tyr | (SEQ ID NO:212) |
| Cys | Cys | Glu | --- | Cys | Cys | Asn | --- | --- | Cys | --- | Gly | Cys | Tyr | (SEQ ID NO:213) |
| Cys | Cys | Glu | --- | Cys | Cys | Asn | --- | --- | Cys | Thr | --- | Cys | Tyr | (SEQ ID NO:214) |
| Cys | Cys | Glu | --- | Cys | Cys | Asn | --- | --- | Cys | Thr | Gly | Cys | --- | (SEQ ID NO:215) |
| Cys | Cys | Glu | --- | Cys | Cys | Asn | --- | Ala | Cys | --- | Gly | Cys | Tyr | (SEQ ID NO:216) |
| Cys | Cys | Glu | --- | Cys | Cys | Asn | --- | Ala | Cys | --- | --- | Cys | Tyr | (SEQ ID NO:217) |
| Cys | Cys | Glu | --- | Cys | Cys | Asn | --- | Ala | Cys | --- | Gly | Cys | --- | (SEQ ID NO:218) |

FIG. 11-2

| | | | | | | | | | | | |
|---|---|---|---|---|---|---|---|---|---|---|---|
| Cys | Cys | Glu | --- | Cys | Cys | Asn | --- | Ala | Cys | Thr | --- | Cys | Tyr | (SEQ ID NO:219) |
| Cys | Cys | Glu | --- | Cys | Cys | Asn | --- | Ala | Cys | Thr | --- | Cys | --- | (SEQ ID NO:220) |
| Cys | Cys | Glu | --- | Cys | Cys | Asn | --- | Ala | Cys | Thr | Gly | Cys | --- | (SEQ ID NO:221) |
| Cys | Cys | Glu | --- | Cys | Cys | Asn | Pro | --- | Cys | Thr | Gly | Cys | Tyr | (SEQ ID NO:222) |
| Cys | Cys | Glu | --- | Cys | Cys | Asn | Pro | --- | Cys | --- | Gly | Cys | Tyr | (SEQ ID NO:223) |
| Cys | Cys | Glu | --- | Cys | Cys | Asn | Pro | --- | Cys | --- | --- | Cys | Tyr | (SEQ ID NO:224) |
| Cys | Cys | Glu | --- | Cys | Cys | Asn | Pro | --- | Cys | --- | Gly | Cys | --- | (SEQ ID NO:225) |
| Cys | Cys | Glu | --- | Cys | Cys | Asn | Pro | --- | Cys | Thr | --- | Cys | Tyr | (SEQ ID NO:226) |
| Cys | Cys | Glu | --- | Cys | Cys | Asn | Pro | --- | Cys | Thr | --- | Cys | --- | (SEQ ID NO:227) |
| Cys | Cys | Glu | --- | Cys | Cys | Asn | Pro | --- | Cys | Thr | Gly | Cys | --- | (SEQ ID NO:228) |
| Cys | Cys | Glu | --- | Cys | Cys | Asn | Pro | Ala | Cys | --- | Gly | Cys | Tyr | (SEQ ID NO:229) |
| Cys | Cys | Glu | --- | Cys | Cys | Asn | Pro | Ala | Cys | --- | --- | Cys | Tyr | (SEQ ID NO:230) |
| Cys | Cys | Glu | --- | Cys | Cys | Asn | Pro | Ala | Cys | --- | --- | Cys | --- | (SEQ ID NO:231) |
| Cys | Cys | Glu | --- | Cys | Cys | Asn | Pro | Ala | Cys | --- | Gly | Cys | --- | (SEQ ID NO:232) |
| Cys | Cys | Glu | --- | Cys | Cys | Asn | Pro | Ala | Cys | Thr | --- | Cys | Tyr | (SEQ ID NO:233) |
| Cys | Cys | Glu | --- | Cys | Cys | Asn | Pro | Ala | Cys | Thr | --- | Cys | --- | (SEQ ID NO:234) |
| Cys | Cys | Glu | --- | Cys | Cys | Asn | Pro | Ala | Cys | Thr | Gly | Cys | --- | (SEQ ID NO:235) |
| Cys | Cys | Glu | Tyr | Cys | Cys | --- | Pro | Ala | Cys | Thr | Gly | Cys | Tyr | (SEQ ID NO:236) |
| Cys | Cys | Glu | Tyr | Cys | Cys | --- | --- | Ala | Cys | Thr | Gly | Cys | Tyr | (SEQ ID NO:237) |
| Cys | Cys | Glu | Tyr | Cys | Cys | --- | --- | --- | Cys | Thr | Gly | Cys | Tyr | (SEQ ID NO:238) |
| Cys | Cys | Glu | Tyr | Cys | Cys | --- | --- | --- | Cys | --- | Gly | Cys | Tyr | (SEQ ID NO:239) |
| Cys | Cys | Glu | Tyr | Cys | Cys | --- | --- | --- | Cys | Thr | --- | Cys | Tyr | (SEQ ID NO:240) |
| Cys | Cys | Glu | Tyr | Cys | Cys | --- | --- | --- | Cys | Thr | Gly | Cys | --- | (SEQ ID NO:241) |
| Cys | Cys | Glu | Tyr | Cys | Cys | --- | --- | Ala | Cys | --- | Gly | Cys | Tyr | (SEQ ID NO:242) |
| Cys | Cys | Glu | Tyr | Cys | Cys | --- | --- | Ala | Cys | --- | --- | Cys | Tyr | (SEQ ID NO:243) |
| Cys | Cys | Glu | Tyr | Cys | Cys | --- | --- | Ala | Cys | --- | Gly | Cys | --- | (SEQ ID NO:244) |
| Cys | Cys | Glu | Tyr | Cys | Cys | --- | --- | Ala | Cys | Thr | --- | Cys | Tyr | (SEQ ID NO:245) |
| Cys | Cys | Glu | Tyr | Cys | Cys | --- | --- | Ala | Cys | Thr | --- | Cys | --- | (SEQ ID NO:246) |
| Cys | Cys | Glu | Tyr | Cys | Cys | --- | --- | Ala | Cys | Thr | Gly | Cys | --- | (SEQ ID NO:247) |
| Cys | Cys | Glu | Tyr | Cys | Cys | --- | Pro | --- | Cys | Thr | Gly | Cys | Tyr | (SEQ ID NO:248) |
| Cys | Cys | Glu | Tyr | Cys | Cys | --- | Pro | --- | Cys | --- | Gly | Cys | Tyr | (SEQ ID NO:249) |
| Cys | Cys | Glu | Tyr | Cys | Cys | --- | Pro | --- | Cys | --- | --- | Cys | Tyr | (SEQ ID NO:250) |
| Cys | Cys | Glu | Tyr | Cys | Cys | --- | Pro | --- | Cys | --- | Gly | Cys | --- | (SEQ ID NO:251) |
| Cys | Cys | Glu | Tyr | Cys | Cys | --- | Pro | --- | Cys | Thr | --- | Cys | Tyr | (SEQ ID NO:252) |
| Cys | Cys | Glu | Tyr | Cys | Cys | --- | Pro | --- | Cys | Thr | --- | Cys | --- | (SEQ ID NO:253) |
| Cys | Cys | Glu | Tyr | Cys | Cys | --- | Pro | --- | Cys | Thr | Gly | Cys | --- | (SEQ ID NO:254) |
| Cys | Cys | Glu | Tyr | Cys | Cys | --- | Pro | Ala | Cys | --- | Gly | Cys | Tyr | (SEQ ID NO:255) |
| Cys | Cys | Glu | Tyr | Cys | Cys | --- | Pro | Ala | Cys | --- | --- | Cys | Tyr | (SEQ ID NO:256) |
| Cys | Cys | Glu | Tyr | Cys | Cys | --- | Pro | Ala | Cys | --- | --- | Cys | --- | (SEQ ID NO:257) |
| Cys | Cys | Glu | Tyr | Cys | Cys | --- | Pro | Ala | Cys | --- | Gly | Cys | --- | (SEQ ID NO:258) |
| Cys | Cys | Glu | Tyr | Cys | Cys | --- | Pro | Ala | Cys | Thr | --- | Cys | Tyr | (SEQ ID NO:259) |
| Cys | Cys | Glu | Tyr | Cys | Cys | --- | Pro | Ala | Cys | Thr | --- | Cys | --- | (SEQ ID NO:260) |
| Cys | Cys | Glu | Tyr | Cys | Cys | --- | Pro | Ala | Cys | Thr | Gly | Cys | --- | (SEQ ID NO:261) |
| Cys | Cys | Glu | Tyr | Cys | Cys | Asn | --- | Ala | Cys | Thr | Gly | Cys | Tyr | (SEQ ID NO:262) |
| Cys | Cys | Glu | Tyr | Cys | Cys | Asn | --- | --- | Cys | Thr | Gly | Cys | Tyr | (SEQ ID NO:263) |
| Cys | Cys | Glu | Tyr | Cys | Cys | Asn | --- | --- | Cys | --- | Gly | Cys | Tyr | (SEQ ID NO:264) |

FIG. 11-3

| | | | | | | | | | | | | |
|---|---|---|---|---|---|---|---|---|---|---|---|---|
| Cys | Cys | Glu | Tyr | Cys | Cys | Asn | --- | --- | Cys | --- | --- | Cys | Tyr | (SEQ ID NO:265) |
| Cys | Cys | Glu | Tyr | Cys | Cys | Asn | --- | --- | Cys | --- | Gly | Cys | --- | (SEQ ID NO:266) |
| Cys | Cys | Glu | Tyr | Cys | Cys | Asn | --- | --- | Cys | Thr | --- | Cys | Tyr | (SEQ ID NO:267) |
| Cys | Cys | Glu | Tyr | Cys | Cys | Asn | --- | --- | Cys | Thr | --- | Cys | --- | (SEQ ID NO:268) |
| Cys | Cys | Glu | Tyr | Cys | Cys | Asn | --- | --- | Cys | Thr | Gly | Cys | --- | (SEQ ID NO:269) |
| Cys | Cys | Glu | Tyr | Cys | Cys | Asn | --- | Ala | Cys | --- | Gly | Cys | Tyr | (SEQ ID NO:270) |
| Cys | Cys | Glu | Tyr | Cys | Cys | Asn | --- | Ala | Cys | --- | --- | Cys | Tyr | (SEQ ID NO:271) |
| Cys | Cys | Glu | Tyr | Cys | Cys | Asn | --- | Ala | Cys | --- | --- | Cys | --- | (SEQ ID NO:272) |
| Cys | Cys | Glu | Tyr | Cys | Cys | Asn | --- | Ala | Cys | --- | Gly | Cys | --- | (SEQ ID NO:273) |
| Cys | Cys | Glu | Tyr | Cys | Cys | Asn | --- | Ala | Cys | Thr | --- | Cys | Tyr | (SEQ ID NO:274) |
| Cys | Cys | Glu | Tyr | Cys | Cys | Asn | --- | Ala | Cys | Thr | --- | Cys | --- | (SEQ ID NO:275) |
| Cys | Cys | Glu | Tyr | Cys | Cys | Asn | --- | Ala | Cys | Thr | Gly | Cys | --- | (SEQ ID NO:276) |
| Cys | Cys | Glu | Tyr | Cys | Cys | Asn | Pro | --- | Cys | Thr | Gly | Cys | Tyr | (SEQ ID NO:277) |
| Cys | Cys | Glu | Tyr | Cys | Cys | Asn | Pro | --- | Cys | --- | Gly | Cys | Tyr | (SEQ ID NO:278) |
| Cys | Cys | Glu | Tyr | Cys | Cys | Asn | Pro | --- | Cys | --- | --- | Cys | Tyr | (SEQ ID NO:279) |
| Cys | Cys | Glu | Tyr | Cys | Cys | Asn | Pro | --- | Cys | --- | --- | Cys | --- | (SEQ ID NO:280) |
| Cys | Cys | Glu | Tyr | Cys | Cys | Asn | Pro | --- | Cys | --- | Gly | Cys | --- | (SEQ ID NO:281) |
| Cys | Cys | Glu | Tyr | Cys | Cys | Asn | Pro | --- | Cys | Thr | --- | Cys | Tyr | (SEQ ID NO:282) |
| Cys | Cys | Glu | Tyr | Cys | Cys | Asn | Pro | --- | Cys | Thr | --- | Cys | --- | (SEQ ID NO:283) |
| Cys | Cys | Glu | Tyr | Cys | Cys | Asn | Pro | --- | Cys | Thr | Gly | Cys | --- | (SEQ ID NO:284) |
| Cys | Cys | Glu | Tyr | Cys | Cys | Asn | Pro | Ala | Cys | --- | Gly | Cys | Tyr | (SEQ ID NO:285) |
| Cys | Cys | Glu | Tyr | Cys | Cys | Asn | Pro | Ala | Cys | --- | --- | Cys | Tyr | (SEQ ID NO:286) |
| Cys | Cys | Glu | Tyr | Cys | Cys | Asn | Pro | Ala | Cys | --- | --- | Cys | --- | (SEQ ID NO:287) |
| Cys | Cys | Glu | Tyr | Cys | Cys | Asn | Pro | Ala | Cys | --- | Gly | Cys | --- | (SEQ ID NO:288) |
| Cys | Cys | Glu | Tyr | Cys | Cys | Asn | Pro | Ala | Cys | Thr | --- | Cys | Tyr | (SEQ ID NO:289) |
| Cys | Cys | Glu | Tyr | Cys | Cys | Asn | Pro | Ala | Cys | Thr | --- | Cys | --- | (SEQ ID NO:290) |
| Cys | Cys | Glu | Tyr | Cys | Cys | Asn | Pro | Ala | Cys | Thr | Gly | Cys | --- | (SEQ ID NO:291) |

FIG. 11-4

| | | | | | | | | | | |
|---|---|---|---|---|---|---|---|---|---|---|
| Cys | Cys | Xaa' | Glu | Tyr | Cys | Cys | Asn | Pro | Ala | Cys | Thr | Gly | Cys | Tyr | (SEQ ID NO: 292) |
| Cys | Cys | Xaa' | Xaa' | Glu | Tyr | Cys | Cys | Asn | Pro | Ala | Cys | Thr | Gly | Cys | Tyr | (SEQ ID NO: 293) |
| Cys | Cys | Xaa' | Xaa' | Xaa' | Glu | Tyr | Cys | Cys | Asn | Pro | Ala | Cys | Thr | Gly | Cys | Tyr | (SEQ ID NO: 294) |
| Cys | Cys | Xaa' | Xaa' | Xaa' | Xaa' | Glu | Tyr | Cys | Cys | Asn | Pro | Ala | Cys | Thr | Gly | Cys | Tyr | (SEQ ID NO: 295) |
| Cys | Cys | Xaa' | Xaa' | Xaa' | Xaa' | Glu | Xaa' | Tyr | Cys | Cys | Asn | Pro | Ala | Cys | Thr | Gly | Cys | Tyr | (SEQ ID NO: 296) |
| Cys | Cys | Xaa' | Xaa' | Xaa' | Xaa' | Glu | Xaa' | Tyr | Cys | Cys | Xaa' | Asn | Pro | Ala | Cys | Thr | Gly | Cys | Tyr | (SEQ ID NO: 297) |
| Cys | Cys | Xaa' | Xaa' | Xaa' | Xaa' | Glu | Xaa' | Tyr | Cys | Cys | Xaa' | Asn | Pro | Ala | Xaa' | Cys | Thr | Gly | Cys | Tyr | (SEQ ID NO: 298) |
| Cys | Cys | Xaa' | Xaa' | Xaa' | Xaa' | Glu | Xaa' | Tyr | Cys | Cys | Xaa' | Asn | Pro | Xaa' | Ala | Cys | Thr | Gly | Cys | Tyr | (SEQ ID NO: 299) |
| Cys | Cys | Xaa' | Xaa' | Xaa' | Xaa' | Glu | Xaa' | Tyr | Cys | Cys | Xaa' | Asn | Pro | Ala | Xaa' | Cys | Thr | Gly | Cys | Tyr | (SEQ ID NO: 300) |
| Cys | Cys | Xaa' | Xaa' | Xaa' | Xaa' | Glu | Xaa' | Tyr | Cys | Cys | Xaa' | Asn | Pro | Ala | Cys | Xaa' | Thr | Gly | Cys | Tyr | (SEQ ID NO: 301) |
| Cys | Cys | Xaa' | Xaa' | Xaa' | Xaa' | Glu | Xaa' | Tyr | Cys | Cys | Xaa' | Asn | Pro | Ala | Cys | Xaa' | Thr | Gly | Cys | Tyr | (SEQ ID NO: 302) |
| Cys | Cys | Xaa' | Xaa' | Xaa' | Xaa' | Glu | Xaa' | Tyr | Cys | Cys | Xaa' | Asn | Pro | Ala | Cys | Thr | Xaa' | Gly | Cys | Tyr | (SEQ ID NO: 303) |
| Cys | Cys | Xaa' | Xaa' | Xaa' | Xaa' | Glu | Xaa' | Tyr | Cys | Cys | Xaa' | Asn | Pro | Ala | Cys | Thr | Gly | Xaa' | Cys | Tyr | (SEQ ID NO: 304) |
| Cys | Cys | Xaa' | Xaa' | Xaa' | Xaa' | Glu | Xaa' | Tyr | Cys | Cys | Xaa' | Asn | Pro | Ala | Cys | Thr | Gly | Cys | Xaa' | Tyr | (SEQ ID NO: 305) |
| Cys | Cys | Xaa' | Xaa' | Xaa' | Xaa' | Glu | Xaa' | Tyr | Xaa' | Cys | Cys | Asn | Pro | Ala | Cys | Thr | Gly | Cys | Tyr | (SEQ ID NO: 306) |
| Cys | Cys | Xaa' | Glu | Xaa' | Tyr | Cys | Cys | Asn | Pro | Ala | Cys | Thr | Gly | Cys | Tyr | (SEQ ID NO: 307) |
| Cys | Cys | Xaa' | Glu | Xaa' | Tyr | Xaa' | Cys | Cys | Asn | Pro | Ala | Cys | Thr | Gly | Cys | Tyr | (SEQ ID NO: 308) |
| Cys | Cys | Xaa' | Glu | Xaa' | Tyr | Cys | Cys | Xaa' | Asn | Pro | Ala | Cys | Thr | Gly | Cys | Tyr | (SEQ ID NO: 309) |
| Cys | Cys | Xaa' | Glu | Xaa' | Tyr | Cys | Cys | Asn | Xaa' | Pro | Ala | Cys | Thr | Gly | Cys | Tyr | (SEQ ID NO: 310) |
| Cys | Cys | Xaa' | Glu | Xaa' | Tyr | Cys | Cys | Asn | Pro | Xaa' | Ala | Cys | Thr | Gly | Cys | Tyr | (SEQ ID NO: 311) |
| Cys | Cys | Xaa' | Glu | Xaa' | Tyr | Cys | Cys | Asn | Pro | Ala | Xaa' | Cys | Thr | Gly | Cys | Tyr | (SEQ ID NO: 312) |
| Cys | Cys | Xaa' | Glu | Xaa' | Tyr | Cys | Cys | Asn | Pro | Ala | Cys | Xaa' | Thr | Gly | Cys | Tyr | (SEQ ID NO: 313) |
| Cys | Cys | Xaa' | Glu | Xaa' | Tyr | Cys | Cys | Asn | Pro | Ala | Cys | Thr | Xaa' | Gly | Cys | Tyr | (SEQ ID NO: 314) |
| Cys | Cys | Xaa' | Glu | Xaa' | Tyr | Cys | Cys | Asn | Pro | Ala | Cys | Thr | Gly | Xaa' | Cys | Tyr | (SEQ ID NO: 315) |
| Cys | Cys | Xaa' | Glu | Tyr | Xaa' | Cys | Cys | Asn | Pro | Ala | Cys | Thr | Gly | Cys | Xaa' | Tyr | (SEQ ID NO: 316) |
| Cys | Cys | Xaa' | Glu | Tyr | Xaa' | Cys | Cys | Xaa' | Asn | Pro | Ala | Cys | Thr | Gly | Cys | Tyr | (SEQ ID NO: 317) |
| Cys | Cys | Xaa' | Glu | Tyr | Xaa' | Xaa' | Cys | Cys | Asn | Pro | Ala | Cys | Thr | Gly | Cys | Tyr | (SEQ ID NO: 318) |
| Cys | Cys | Xaa' | Glu | Tyr | Xaa' | Cys | Cys | Xaa' | Asn | Pro | Ala | Cys | Thr | Gly | Cys | Tyr | (SEQ ID NO: 319) |

FIG. 12-1

| | | | | | | | | | | | |
|---|---|---|---|---|---|---|---|---|---|---|---|
| Cys | Cys | Xaa' | Xaa' | Glu | Tyr | Xaa' | Cys | Cys | Asn | Xaa' | Pro | Ala | Cys | Thr | Gly | Cys | Tyr | (SEQ ID NO: 320) |
| Cys | Cys | Xaa' | Xaa' | Glu | Tyr | Xaa' | Cys | Cys | Asn | Pro | Xaa' | Ala | Cys | Thr | Gly | Cys | Tyr | (SEQ ID NO: 321) |
| Cys | Cys | Xaa' | Xaa' | Glu | Tyr | Xaa' | Cys | Cys | Asn | Pro | Ala | Xaa' | Cys | Thr | Gly | Cys | Tyr | (SEQ ID NO: 322) |
| Cys | Cys | Xaa' | Xaa' | Glu | Tyr | Xaa' | Cys | Cys | Asn | Pro | Ala | Cys | Xaa' | Thr | Gly | Cys | Tyr | (SEQ ID NO: 323) |
| Cys | Cys | Xaa' | Xaa' | Glu | Tyr | Xaa' | Cys | Cys | Asn | Pro | Ala | Cys | Thr | Xaa' | Gly | Cys | Tyr | (SEQ ID NO: 324) |
| Cys | Cys | Xaa' | Xaa' | Glu | Tyr | Xaa' | Cys | Cys | Asn | Pro | Ala | Cys | Thr | Gly | Xaa' | Cys | Tyr | (SEQ ID NO: 325) |
| Cys | Cys | Xaa' | Xaa' | Glu | Tyr | Xaa' | Cys | Cys | Asn | Pro | Ala | Cys | Thr | Gly | Cys | Xaa' | Tyr | (SEQ ID NO: 326) |
| Cys | Cys | Xaa' | Xaa' | Glu | Tyr | Cys | Xaa' | Asn | Pro | Ala | Cys | Thr | Gly | Cys | Tyr | | | (SEQ ID NO: 327) |
| Cys | Cys | Xaa' | Xaa' | Glu | Tyr | Cys | Xaa' | Xaa' | Asn | Pro | Ala | Cys | Thr | Gly | Cys | Tyr | | (SEQ ID NO: 328) |
| Cys | Cys | Xaa' | Xaa' | Glu | Tyr | Cys | Xaa' | Asn | Xaa' | Pro | Ala | Cys | Thr | Gly | Cys | Tyr | | (SEQ ID NO: 329) |
| Cys | Cys | Xaa' | Xaa' | Glu | Tyr | Cys | Xaa' | Asn | Pro | Xaa' | Ala | Cys | Thr | Gly | Cys | Tyr | | (SEQ ID NO: 330) |
| Cys | Cys | Xaa' | Xaa' | Glu | Tyr | Cys | Xaa' | Asn | Pro | Ala | Xaa' | Cys | Thr | Gly | Cys | Tyr | | (SEQ ID NO: 331) |
| Cys | Cys | Xaa' | Xaa' | Glu | Tyr | Cys | Xaa' | Asn | Pro | Ala | Cys | Xaa' | Thr | Gly | Cys | Tyr | | (SEQ ID NO: 332) |
| Cys | Cys | Xaa' | Xaa' | Glu | Tyr | Cys | Xaa' | Asn | Pro | Ala | Cys | Thr | Xaa' | Gly | Cys | Tyr | | (SEQ ID NO: 333) |
| Cys | Cys | Xaa' | Xaa' | Glu | Tyr | Cys | Xaa' | Asn | Pro | Ala | Cys | Thr | Gly | Xaa' | Cys | Tyr | | (SEQ ID NO: 334) |
| Cys | Cys | Xaa' | Xaa' | Glu | Tyr | Cys | Xaa' | Asn | Pro | Ala | Cys | Thr | Gly | Cys | Xaa' | Tyr | | (SEQ ID NO: 335) |
| Cys | Cys | Xaa' | Xaa' | Glu | Tyr | Cys | Cys | Asn | Xaa' | Pro | Ala | Cys | Thr | Gly | Cys | Tyr | | (SEQ ID NO: 336) |
| Cys | Cys | Xaa' | Xaa' | Glu | Tyr | Cys | Cys | Xaa' | Asn | Pro | Ala | Cys | Thr | Gly | Cys | Tyr | | (SEQ ID NO: 337) |
| Cys | Cys | Xaa' | Xaa' | Glu | Tyr | Cys | Cys | Asn | Xaa' | Pro | Ala | Cys | Thr | Gly | Cys | Tyr | | (SEQ ID NO: 338) |
| Cys | Cys | Xaa' | Xaa' | Glu | Tyr | Cys | Cys | Asn | Pro | Xaa' | Ala | Cys | Thr | Gly | Cys | Tyr | | (SEQ ID NO: 339) |
| Cys | Cys | Xaa' | Xaa' | Glu | Tyr | Cys | Cys | Asn | Pro | Ala | Xaa' | Cys | Thr | Gly | Cys | Tyr | | (SEQ ID NO: 340) |
| Cys | Cys | Xaa' | Xaa' | Glu | Tyr | Cys | Cys | Asn | Pro | Ala | Cys | Xaa' | Thr | Gly | Cys | Tyr | | (SEQ ID NO: 341) |
| Cys | Cys | Xaa' | Xaa' | Glu | Tyr | Cys | Cys | Asn | Pro | Ala | Cys | Thr | Xaa' | Gly | Cys | Tyr | | (SEQ ID NO: 342) |
| Cys | Cys | Xaa' | Xaa' | Glu | Tyr | Cys | Cys | Asn | Pro | Ala | Cys | Thr | Gly | Xaa' | Cys | Tyr | | (SEQ ID NO: 343) |
| Cys | Cys | Xaa' | Xaa' | Glu | Tyr | Cys | Cys | Asn | Pro | Ala | Cys | Thr | Gly | Cys | Xaa' | Tyr | | (SEQ ID NO: 344) |
| Cys | Cys | Xaa' | Xaa' | Glu | Tyr | Cys | Cys | Asn | Xaa' | Ala | Cys | Thr | Gly | Cys | Tyr | | | (SEQ ID NO: 345) |
| Cys | Cys | Xaa' | Xaa' | Glu | Tyr | Cys | Cys | Asn | Pro | Xaa' | Cys | Thr | Gly | Cys | Tyr | | | (SEQ ID NO: 346) |
| Cys | Cys | Xaa' | Xaa' | Glu | Tyr | Cys | Cys | Asn | Pro | Ala | Xaa' | Thr | Gly | Cys | Tyr | | | (SEQ ID NO: 347) |
| Cys | Cys | Xaa' | Xaa' | Glu | Tyr | Cys | Cys | Asn | Pro | Ala | Cys | Xaa' | Gly | Cys | Tyr | | | (SEQ ID NO: 348) |
| Cys | Cys | Xaa' | Xaa' | Glu | Tyr | Cys | Cys | Asn | Pro | Ala | Cys | Thr | Gly | Xaa' | Cys | Tyr | | (SEQ ID NO: 349) |

FIG. 12-2

| | | | | | | | | | | | | | |
|---|---|---|---|---|---|---|---|---|---|---|---|---|---|
| Cys | Cys | Xaa' | Xaa' | Glu | Tyr | Cys | Cys | Asn | Pro | Xaa' | Ala | Cys | Thr | Gly | Cys | Xaa' | Tyr | (SEQ ID NO: 350) |
| Cys | Cys | Xaa' | Xaa' | Glu | Tyr | Cys | Cys | Asn | Pro | Ala | Xaa' | Cys | Thr | Gly | Cys | Tyr | (SEQ ID NO: 351) |
| Cys | Cys | Xaa' | Xaa' | Glu | Tyr | Cys | Cys | Asn | Pro | Ala | Xaa' | Xaa' | Cys | Thr | Gly | Cys | Tyr | (SEQ ID NO: 352) |
| Cys | Cys | Xaa' | Xaa' | Glu | Tyr | Cys | Cys | Asn | Pro | Ala | Xaa' | Cys | Xaa' | Thr | Gly | Cys | Tyr | (SEQ ID NO: 353) |
| Cys | Cys | Xaa' | Xaa' | Glu | Tyr | Cys | Cys | Asn | Pro | Ala | Cys | Thr | Xaa' | Gly | Cys | Tyr | (SEQ ID NO: 354) |
| Cys | Cys | Xaa' | Xaa' | Glu | Tyr | Cys | Cys | Asn | Pro | Ala | Cys | Thr | Gly | Xaa' | Cys | Tyr | (SEQ ID NO: 355) |
| Cys | Cys | Xaa' | Xaa' | Glu | Tyr | Cys | Cys | Asn | Pro | Ala | Cys | Thr | Gly | Cys | Xaa' | Tyr | (SEQ ID NO: 356) |
| Cys | Cys | Xaa' | Xaa' | Glu | Tyr | Cys | Cys | Asn | Pro | Ala | Cys | Xaa' | Thr | Gly | Cys | Tyr | (SEQ ID NO: 357) |
| Cys | Cys | Xaa' | Xaa' | Glu | Tyr | Cys | Cys | Asn | Pro | Ala | Cys | Xaa' | Thr | Gly | Cys | Tyr | (SEQ ID NO: 358) |
| Cys | Cys | Xaa' | Xaa' | Glu | Tyr | Cys | Cys | Asn | Pro | Ala | Cys | Xaa' | Thr | Gly | Cys | Tyr | (SEQ ID NO: 359) |
| Cys | Cys | Xaa' | Xaa' | Glu | Tyr | Cys | Cys | Asn | Pro | Ala | Cys | Xaa' | Thr | Gly | Xaa' | Cys | Tyr | (SEQ ID NO: 360) |
| Cys | Cys | Xaa' | Xaa' | Glu | Tyr | Cys | Cys | Asn | Pro | Ala | Cys | Xaa' | Thr | Gly | Cys | Xaa' | Tyr | (SEQ ID NO: 361) |
| Cys | Cys | Xaa' | Xaa' | Glu | Tyr | Cys | Cys | Asn | Pro | Ala | Cys | Xaa' | Thr | Gly | Cys | Tyr | (SEQ ID NO: 362) |
| Cys | Cys | Xaa' | Xaa' | Glu | Tyr | Cys | Cys | Asn | Pro | Ala | Cys | Xaa' | Xaa' | Thr | Gly | Cys | Tyr | (SEQ ID NO: 363) |
| Cys | Cys | Xaa' | Xaa' | Glu | Tyr | Cys | Cys | Asn | Pro | Ala | Cys | Xaa' | Xaa' | Gly | Cys | Tyr | (SEQ ID NO: 364) |
| Cys | Cys | Xaa' | Xaa' | Glu | Tyr | Cys | Cys | Asn | Pro | Ala | Cys | Xaa' | Thr | Gly | Xaa' | Cys | Tyr | (SEQ ID NO: 365) |
| Cys | Cys | Xaa' | Xaa' | Glu | Tyr | Cys | Cys | Asn | Pro | Ala | Cys | Xaa' | Thr | Gly | Cys | Xaa' | Tyr | (SEQ ID NO: 366) |
| Cys | Cys | Xaa' | Xaa' | Glu | Tyr | Cys | Cys | Asn | Pro | Ala | Cys | Xaa' | Xaa' | Cys | Tyr | (SEQ ID NO: 367) |
| Cys | Cys | Xaa' | Xaa' | Glu | Tyr | Cys | Cys | Asn | Pro | Ala | Cys | Xaa' | Xaa' | Cys | Xaa' | Tyr | (SEQ ID NO: 368) |
| Cys | Cys | Xaa' | Xaa' | Glu | Tyr | Cys | Cys | Asn | Pro | Ala | Cys | Thr | Gly | Cys | Xaa' | Xaa' | Tyr | (SEQ ID NO: 369) |
| Cys | Cys | Xaa' | Glu | Tyr | Cys | Cys | Asn | Pro | Ala | Cys | Thr | Gly | Cys | Tyr | (SEQ ID NO: 370) |
| Cys | Cys | Xaa' | Xaa' | Glu | Xaa' | Cys | Cys | Asn | Pro | Ala | Cys | Thr | Gly | Cys | Xaa' | Tyr | (SEQ ID NO: 371) |
| Cys | Cys | Xaa' | Xaa' | Glu | Xaa' | Tyr | Cys | Cys | Asn | Pro | Ala | Cys | Thr | Gly | Cys | Tyr | (SEQ ID NO: 372) |
| Cys | Cys | Xaa' | Glu | Xaa' | Xaa' | Tyr | Cys | Xaa' | Cys | Asn | Pro | Ala | Cys | Thr | Gly | Cys | Tyr | (SEQ ID NO: 373) |
| Cys | Cys | Xaa' | Glu | Xaa' | Xaa' | Tyr | Cys | Cys | Asn | Pro | Ala | Cys | Thr | Gly | Cys | Tyr | (SEQ ID NO: 374) |
| Cys | Cys | Xaa' | Glu | Xaa' | Tyr | Cys | Cys | Asn | Pro | Ala | Cys | Thr | Gly | Cys | Tyr | (SEQ ID NO: 375) |
| Cys | Cys | Xaa' | Glu | Xaa' | Tyr | Cys | Cys | Xaa' | Asn | Pro | Ala | Cys | Thr | Gly | Cys | Tyr | (SEQ ID NO: 376) |
| Cys | Cys | Xaa' | Glu | Xaa' | Tyr | Cys | Cys | Cys | Asn | Pro | Ala | Cys | Thr | Gly | Cys | Tyr | (SEQ ID NO: 377) |
| Cys | Cys | Xaa' | Glu | Xaa' | Tyr | Cys | Cys | Cys | Asn | Pro | Ala | Xaa' | Cys | Thr | Gly | Cys | Tyr | (SEQ ID NO: 378) |
| Cys | Cys | Xaa' | Glu | Xaa' | Tyr | Cys | Cys | Asn | Pro | Ala | Cys | Xaa' | Thr | Gly | Cys | Tyr | (SEQ ID NO: 379) |

FIG. 12-3

| | | | | | | | | | | |
|---|---|---|---|---|---|---|---|---|---|---|
| Cys Cys Xaa' Glu Xaa' Xaa' Xaa' Tyr Cys Cys Asn Pro Ala Cys Thr Xaa' Gly Cys Tyr | (SEQ ID NO: 380) |
| Cys Cys Xaa' Glu Xaa' Xaa' Xaa' Tyr Cys Cys Asn Pro Ala Cys Thr Gly Xaa' Cys Tyr | (SEQ ID NO: 381) |
| Cys Cys Xaa' Glu Xaa' Xaa' Tyr Cys Cys Asn Pro Ala Cys Thr Gly Cys Xaa' Tyr | (SEQ ID NO: 382) |
| Cys Cys Xaa' Glu Xaa' Tyr Xaa' Cys Cys Asn Pro Ala Cys Thr Gly Cys Tyr | (SEQ ID NO: 383) |
| Cys Cys Xaa' Glu Xaa' Tyr Xaa' Cys Cys Xaa' Asn Pro Ala Cys Thr Gly Cys Tyr | (SEQ ID NO: 384) |
| Cys Cys Xaa' Glu Xaa' Tyr Xaa' Cys Cys Asn Xaa' Pro Ala Cys Thr Gly Cys Tyr | (SEQ ID NO: 385) |
| Cys Cys Xaa' Glu Xaa' Tyr Xaa' Cys Cys Asn Pro Ala Cys Thr Gly Cys Tyr | (SEQ ID NO: 386) |
| Cys Cys Xaa' Glu Xaa' Tyr Xaa' Cys Cys Xaa' Asn Pro Xaa' Ala Cys Thr Gly Cys Tyr | (SEQ ID NO: 387) |
| Cys Cys Xaa' Glu Xaa' Tyr Xaa' Cys Cys Asn Pro Ala Xaa' Cys Thr Gly Cys Tyr | (SEQ ID NO: 388) |
| Cys Cys Xaa' Glu Xaa' Tyr Xaa' Cys Cys Asn Pro Ala Cys Xaa' Thr Gly Cys Tyr | (SEQ ID NO: 389) |
| Cys Cys Xaa' Glu Xaa' Tyr Xaa' Cys Cys Asn Pro Ala Cys Thr Xaa' Gly Cys Tyr | (SEQ ID NO: 390) |
| Cys Cys Xaa' Glu Xaa' Tyr Xaa' Cys Cys Asn Pro Ala Cys Thr Gly Xaa' Cys Tyr | (SEQ ID NO: 391) |
| Cys Cys Xaa' Glu Xaa' Tyr Xaa' Cys Cys Asn Pro Ala Cys Thr Gly Cys Xaa' Tyr | (SEQ ID NO: 392) |
| Cys Cys Xaa' Glu Xaa' Tyr Cys Cys Xaa' Asn Pro Ala Cys Thr Gly Cys Tyr | (SEQ ID NO: 393) |
| Cys Cys Xaa' Glu Xaa' Tyr Cys Cys Xaa' Asn Pro Ala Cys Thr Gly Cys Tyr | (SEQ ID NO: 394) |
| Cys Cys Xaa' Glu Xaa' Tyr Cys Cys Xaa' Asn Xaa' Pro Ala Cys Thr Gly Cys Tyr | (SEQ ID NO: 395) |
| Cys Cys Xaa' Glu Xaa' Tyr Cys Cys Xaa' Asn Pro Xaa' Ala Cys Thr Gly Cys Tyr | (SEQ ID NO: 396) |
| Cys Cys Xaa' Glu Xaa' Tyr Cys Cys Xaa' Asn Pro Ala Xaa' Cys Thr Gly Cys Tyr | (SEQ ID NO: 397) |
| Cys Cys Xaa' Glu Xaa' Tyr Cys Cys Xaa' Asn Pro Ala Cys Xaa' Thr Gly Cys Tyr | (SEQ ID NO: 398) |
| Cys Cys Xaa' Glu Xaa' Tyr Cys Cys Xaa' Asn Pro Ala Cys Thr Xaa' Gly Cys Tyr | (SEQ ID NO: 399) |
| Cys Cys Xaa' Glu Xaa' Tyr Cys Cys Xaa' Asn Pro Ala Cys Thr Gly Xaa' Cys Tyr | (SEQ ID NO: 400) |
| Cys Cys Xaa' Glu Xaa' Tyr Cys Cys Asn Xaa' Pro Ala Cys Thr Gly Cys Xaa' Tyr | (SEQ ID NO: 401) |
| Cys Cys Xaa' Glu Xaa' Tyr Cys Cys Asn Xaa' Pro Ala Cys Thr Gly Cys Tyr | (SEQ ID NO: 402) |
| Cys Cys Xaa' Glu Xaa' Tyr Cys Cys Asn Xaa' Pro Xaa' Ala Cys Thr Gly Cys Tyr | (SEQ ID NO: 403) |
| Cys Cys Xaa' Glu Xaa' Tyr Cys Cys Asn Xaa' Pro Ala Xaa' Cys Thr Gly Cys Tyr | (SEQ ID NO: 404) |
| Cys Cys Xaa' Glu Xaa' Tyr Cys Cys Asn Xaa' Pro Ala Cys Xaa' Thr Gly Cys Tyr | (SEQ ID NO: 405) |
| Cys Cys Xaa' Glu Xaa' Tyr Cys Cys Asn Xaa' Pro Ala Cys Thr Xaa' Gly Cys Tyr | (SEQ ID NO: 406) |
| Cys Cys Xaa' Glu Xaa' Tyr Cys Cys Asn Xaa' Pro Ala Cys Thr Gly Xaa' Cys Tyr | (SEQ ID NO: 407) |
| Cys Cys Xaa' Glu Xaa' Tyr Cys Cys Asn Xaa' Pro Ala Cys Thr Gly Cys Xaa' Tyr | (SEQ ID NO: 408) |
| Cys Cys Xaa' Glu Xaa' Tyr Cys Cys Asn Xaa' Pro Ala Cys Thr Gly Cys Xaa' Tyr | (SEQ ID NO: 409) |

FIG. 12-4

| | | | | | | | | | | | | |
|---|---|---|---|---|---|---|---|---|---|---|---|---|
| Cys | Cys | Xaa' | Glu | Xaa' | Tyr | Cys | Cys | Asn | Pro | Xaa' | Ala | Cys | Thr | Gly | Cys | Tyr | (SEQ ID NO: 410) |
| Cys | Cys | Xaa' | Glu | Xaa' | Tyr | Cys | Cys | Asn | Pro | Xaa' | Xaa' | Ala | Cys | Thr | Gly | Cys | Tyr | (SEQ ID NO: 411) |
| Cys | Cys | Xaa' | Glu | Xaa' | Tyr | Cys | Cys | Asn | Pro | Xaa' | Ala | Xaa' | Cys | Thr | Gly | Cys | Tyr | (SEQ ID NO: 412) |
| Cys | Cys | Xaa' | Glu | Xaa' | Tyr | Cys | Cys | Asn | Pro | Xaa' | Ala | Cys | Xaa' | Thr | Gly | Cys | Tyr | (SEQ ID NO: 413) |
| Cys | Cys | Xaa' | Glu | Xaa' | Tyr | Cys | Cys | Asn | Pro | Xaa' | Ala | Cys | Thr | Xaa' | Gly | Cys | Tyr | (SEQ ID NO: 414) |
| Cys | Cys | Xaa' | Glu | Xaa' | Tyr | Cys | Cys | Asn | Pro | Xaa' | Ala | Cys | Thr | Gly | Xaa' | Cys | Tyr | (SEQ ID NO: 415) |
| Cys | Cys | Xaa' | Glu | Xaa' | Tyr | Cys | Cys | Asn | Pro | Xaa' | Ala | Cys | Thr | Gly | Cys | Xaa' | Tyr | (SEQ ID NO: 416) |
| Cys | Cys | Xaa' | Glu | Xaa' | Tyr | Cys | Cys | Asn | Pro | Ala | Xaa' | Cys | Thr | Gly | Cys | Tyr | (SEQ ID NO: 417) |
| Cys | Cys | Xaa' | Glu | Xaa' | Tyr | Cys | Cys | Asn | Pro | Ala | Xaa' | Xaa' | Cys | Thr | Gly | Cys | Tyr | (SEQ ID NO: 418) |
| Cys | Cys | Xaa' | Glu | Xaa' | Tyr | Cys | Cys | Asn | Pro | Ala | Xaa' | Cys | Xaa' | Thr | Gly | Cys | Tyr | (SEQ ID NO: 419) |
| Cys | Cys | Xaa' | Glu | Xaa' | Tyr | Cys | Cys | Asn | Pro | Ala | Xaa' | Cys | Thr | Xaa' | Gly | Cys | Tyr | (SEQ ID NO: 420) |
| Cys | Cys | Xaa' | Glu | Xaa' | Tyr | Cys | Cys | Asn | Pro | Ala | Xaa' | Cys | Thr | Gly | Xaa' | Cys | Tyr | (SEQ ID NO: 421) |
| Cys | Cys | Xaa' | Glu | Xaa' | Tyr | Cys | Cys | Asn | Pro | Ala | Xaa' | Cys | Thr | Gly | Cys | Xaa' | Tyr | (SEQ ID NO: 422) |
| Cys | Cys | Xaa' | Glu | Xaa' | Tyr | Cys | Cys | Asn | Pro | Ala | Cys | Xaa' | Thr | Gly | Cys | Tyr | (SEQ ID NO: 423) |
| Cys | Cys | Xaa' | Glu | Xaa' | Tyr | Cys | Cys | Asn | Pro | Ala | Cys | Xaa' | Xaa' | Thr | Gly | Cys | Tyr | (SEQ ID NO: 424) |
| Cys | Cys | Xaa' | Glu | Xaa' | Tyr | Cys | Cys | Asn | Pro | Ala | Cys | Xaa' | Thr | Xaa' | Gly | Cys | Tyr | (SEQ ID NO: 425) |
| Cys | Cys | Xaa' | Glu | Xaa' | Tyr | Cys | Cys | Asn | Pro | Ala | Cys | Xaa' | Thr | Gly | Xaa' | Cys | Tyr | (SEQ ID NO: 426) |
| Cys | Cys | Xaa' | Glu | Xaa' | Tyr | Cys | Cys | Asn | Pro | Ala | Cys | Xaa' | Thr | Gly | Cys | Xaa' | Tyr | (SEQ ID NO: 427) |
| Cys | Cys | Xaa' | Glu | Xaa' | Tyr | Cys | Cys | Asn | Pro | Ala | Cys | Thr | Xaa' | Gly | Cys | Tyr | (SEQ ID NO: 428) |
| Cys | Cys | Xaa' | Glu | Xaa' | Tyr | Cys | Cys | Asn | Pro | Ala | Cys | Thr | Xaa' | Xaa' | Gly | Cys | Tyr | (SEQ ID NO: 429) |
| Cys | Cys | Xaa' | Glu | Xaa' | Tyr | Cys | Cys | Asn | Pro | Ala | Cys | Thr | Xaa' | Gly | Xaa' | Cys | Tyr | (SEQ ID NO: 430) |
| Cys | Cys | Xaa' | Glu | Xaa' | Tyr | Cys | Cys | Asn | Pro | Ala | Cys | Thr | Xaa' | Gly | Cys | Xaa' | Tyr | (SEQ ID NO: 431) |
| Cys | Cys | Xaa' | Glu | Xaa' | Tyr | Cys | Cys | Asn | Pro | Ala | Cys | Thr | Gly | Xaa' | Cys | Tyr | (SEQ ID NO: 432) |
| Cys | Cys | Xaa' | Glu | Xaa' | Tyr | Cys | Cys | Asn | Pro | Ala | Cys | Thr | Gly | Xaa' | Xaa' | Cys | Tyr | (SEQ ID NO: 433) |
| Cys | Cys | Xaa' | Glu | Xaa' | Tyr | Cys | Cys | Asn | Pro | Ala | Cys | Thr | Gly | Xaa' | Cys | Xaa' | Tyr | (SEQ ID NO: 434) |
| Cys | Cys | Xaa' | Glu | Xaa' | Tyr | Cys | Cys | Asn | Pro | Ala | Cys | Thr | Gly | Cys | Xaa' | Tyr | (SEQ ID NO: 435) |
| Cys | Cys | Xaa' | Glu | Xaa' | Tyr | Cys | Cys | Asn | Pro | Ala | Cys | Thr | Gly | Cys | Xaa' | Xaa' | Tyr | (SEQ ID NO: 436) |
| Cys | Cys | Xaa' | Glu | Tyr | Xaa' | Cys | Cys | Asn | Pro | Ala | Cys | Thr | Gly | Cys | Tyr | (SEQ ID NO: 437) |
| Cys | Cys | Xaa' | Glu | Tyr | Xaa' | Xaa' | Cys | Cys | Asn | Pro | Ala | Cys | Thr | Gly | Cys | Tyr | (SEQ ID NO: 438) |
| Cys | Cys | Xaa' | Glu | Tyr | Xaa' | Xaa' | Cys | Cys | Asn | Pro | Ala | Cys | Thr | Gly | Cys | Tyr | (SEQ ID NO: 439) |

FIG. 12-5

| | | | | | | | | | | | |
|---|---|---|---|---|---|---|---|---|---|---|---|
| Cys | Cys | Xaa' | Glu | Tyr | Xaa' | Xaa' | Cys | Cys | Xaa' | Asn | Pro | Ala | Cys | Thr | Gly | Cys | Tyr | (SEQ ID NO: 440) |
| Cys | Cys | Xaa' | Glu | Tyr | Xaa' | Xaa' | Cys | Cys | Asn | Xaa' | Pro | Ala | Cys | Thr | Gly | Cys | Tyr | (SEQ ID NO: 441) |
| Cys | Cys | Xaa' | Glu | Tyr | Xaa' | Xaa' | Cys | Cys | Asn | Pro | Xaa' | Ala | Cys | Thr | Gly | Cys | Tyr | (SEQ ID NO: 442) |
| Cys | Cys | Xaa' | Glu | Tyr | Xaa' | Xaa' | Cys | Cys | Asn | Pro | Ala | Xaa' | Cys | Thr | Gly | Cys | Tyr | (SEQ ID NO: 443) |
| Cys | Cys | Xaa' | Glu | Tyr | Xaa' | Xaa' | Cys | Cys | Asn | Pro | Ala | Cys | Xaa' | Thr | Gly | Cys | Tyr | (SEQ ID NO: 444) |
| Cys | Cys | Xaa' | Glu | Tyr | Xaa' | Xaa' | Cys | Cys | Asn | Pro | Ala | Cys | Thr | Xaa' | Gly | Cys | Tyr | (SEQ ID NO: 445) |
| Cys | Cys | Xaa' | Glu | Tyr | Xaa' | Xaa' | Cys | Cys | Asn | Pro | Ala | Cys | Thr | Gly | Xaa' | Cys | Tyr | (SEQ ID NO: 446) |
| Cys | Cys | Xaa' | Glu | Tyr | Xaa' | Xaa' | Cys | Cys | Asn | Pro | Ala | Cys | Thr | Gly | Cys | Xaa' | Tyr | (SEQ ID NO: 447) |
| Cys | Cys | Xaa' | Glu | Tyr | Xaa' | Cys | Cys | Xaa' | Asn | Pro | Ala | Cys | Thr | Gly | Cys | Tyr | | (SEQ ID NO: 448) |
| Cys | Cys | Xaa' | Glu | Tyr | Xaa' | Cys | Cys | Xaa' | Xaa' | Asn | Pro | Ala | Cys | Thr | Gly | Cys | Tyr | (SEQ ID NO: 449) |
| Cys | Cys | Xaa' | Glu | Tyr | Xaa' | Cys | Cys | Xaa' | Asn | Xaa' | Pro | Ala | Cys | Thr | Gly | Cys | Tyr | (SEQ ID NO: 450) |
| Cys | Cys | Xaa' | Glu | Tyr | Xaa' | Cys | Cys | Xaa' | Asn | Pro | Xaa' | Ala | Cys | Thr | Gly | Cys | Tyr | (SEQ ID NO: 451) |
| Cys | Cys | Xaa' | Glu | Tyr | Xaa' | Cys | Cys | Xaa' | Asn | Pro | Ala | Xaa' | Cys | Thr | Gly | Cys | Tyr | (SEQ ID NO: 452) |
| Cys | Cys | Xaa' | Glu | Tyr | Xaa' | Cys | Cys | Xaa' | Asn | Pro | Ala | Cys | Xaa' | Thr | Gly | Cys | Tyr | (SEQ ID NO: 453) |
| Cys | Cys | Xaa' | Glu | Tyr | Xaa' | Cys | Cys | Xaa' | Asn | Pro | Ala | Cys | Thr | Xaa' | Gly | Cys | Tyr | (SEQ ID NO: 454) |
| Cys | Cys | Xaa' | Glu | Tyr | Xaa' | Cys | Cys | Xaa' | Asn | Pro | Ala | Cys | Thr | Gly | Xaa' | Cys | Tyr | (SEQ ID NO: 455) |
| Cys | Cys | Xaa' | Glu | Tyr | Xaa' | Cys | Cys | Xaa' | Asn | Pro | Ala | Cys | Thr | Gly | Cys | Xaa' | Tyr | (SEQ ID NO: 456) |
| Cys | Cys | Xaa' | Glu | Tyr | Xaa' | Cys | Cys | Asn | Xaa' | Pro | Ala | Cys | Thr | Gly | Cys | Tyr | | (SEQ ID NO: 457) |
| Cys | Cys | Xaa' | Glu | Tyr | Xaa' | Cys | Cys | Asn | Xaa' | Xaa' | Pro | Ala | Cys | Thr | Gly | Cys | Tyr | (SEQ ID NO: 458) |
| Cys | Cys | Xaa' | Glu | Tyr | Xaa' | Cys | Cys | Asn | Xaa' | Pro | Xaa' | Ala | Cys | Thr | Gly | Cys | Tyr | (SEQ ID NO: 459) |
| Cys | Cys | Xaa' | Glu | Tyr | Xaa' | Cys | Cys | Asn | Xaa' | Pro | Ala | Xaa' | Cys | Thr | Gly | Cys | Tyr | (SEQ ID NO: 460) |
| Cys | Cys | Xaa' | Glu | Tyr | Xaa' | Cys | Cys | Asn | Xaa' | Pro | Ala | Cys | Xaa' | Thr | Gly | Cys | Tyr | (SEQ ID NO: 461) |
| Cys | Cys | Xaa' | Glu | Tyr | Xaa' | Cys | Cys | Asn | Xaa' | Pro | Ala | Cys | Thr | Xaa' | Gly | Cys | Tyr | (SEQ ID NO: 462) |
| Cys | Cys | Xaa' | Glu | Tyr | Xaa' | Cys | Cys | Asn | Xaa' | Pro | Ala | Cys | Thr | Gly | Xaa' | Cys | Tyr | (SEQ ID NO: 463) |
| Cys | Cys | Xaa' | Glu | Tyr | Xaa' | Cys | Cys | Asn | Xaa' | Pro | Ala | Cys | Thr | Gly | Cys | Xaa' | Tyr | (SEQ ID NO: 464) |
| Cys | Cys | Xaa' | Glu | Tyr | Xaa' | Cys | Cys | Asn | Pro | Xaa' | Ala | Cys | Thr | Gly | Cys | Tyr | | (SEQ ID NO: 465) |
| Cys | Cys | Xaa' | Glu | Tyr | Xaa' | Cys | Cys | Asn | Pro | Xaa' | Xaa' | Ala | Cys | Thr | Gly | Cys | Tyr | (SEQ ID NO: 466) |
| Cys | Cys | Xaa' | Glu | Tyr | Xaa' | Cys | Cys | Asn | Pro | Xaa' | Ala | Xaa' | Cys | Thr | Gly | Cys | Tyr | (SEQ ID NO: 467) |
| Cys | Cys | Xaa' | Glu | Tyr | Xaa' | Cys | Cys | Asn | Pro | Xaa' | Ala | Cys | Xaa' | Thr | Gly | Cys | Tyr | (SEQ ID NO: 468) |

FIG. 12-6

| | | | | | | | | | | | | |
|---|---|---|---|---|---|---|---|---|---|---|---|---|
| Cys | Cys | Xaa' | Glu | Tyr | Cys | Cys | Xaa' | Xaa' | Asn | Pro | Ala | Cys | Xaa' | Thr | Gly | Cys | Tyr | (SEQ ID NO: 498) |
| Cys | Cys | Xaa' | Glu | Tyr | Cys | Cys | Xaa' | Xaa' | Asn | Pro | Ala | Cys | Thr | Xaa' | Gly | Cys | Tyr | (SEQ ID NO: 499) |
| Cys | Cys | Xaa' | Glu | Tyr | Cys | Cys | Xaa' | Xaa' | Asn | Pro | Ala | Cys | Thr | Gly | Xaa' | Cys | Tyr | (SEQ ID NO: 500) |
| Cys | Cys | Xaa' | Glu | Tyr | Cys | Cys | Xaa' | Xaa' | Asn | Pro | Ala | Cys | Thr | Gly | Cys | Xaa' | Tyr | (SEQ ID NO: 501) |
| Cys | Cys | Xaa' | Glu | Tyr | Cys | Cys | Xaa' | Asn | Xaa' | Pro | Ala | Cys | Thr | Gly | Cys | Tyr | (SEQ ID NO: 502) |
| Cys | Cys | Xaa' | Glu | Tyr | Cys | Cys | Xaa' | Asn | Xaa' | Pro | Ala | Cys | Xaa' | Thr | Gly | Cys | Tyr | (SEQ ID NO: 503) |
| Cys | Cys | Xaa' | Glu | Tyr | Cys | Cys | Xaa' | Asn | Xaa' | Pro | Ala | Cys | Thr | Xaa' | Gly | Cys | Tyr | (SEQ ID NO: 504) |
| Cys | Cys | Xaa' | Glu | Tyr | Cys | Cys | Xaa' | Asn | Xaa' | Pro | Ala | Cys | Thr | Gly | Xaa' | Cys | Tyr | (SEQ ID NO: 505) |
| Cys | Cys | Xaa' | Glu | Tyr | Cys | Cys | Xaa' | Asn | Xaa' | Pro | Ala | Cys | Thr | Gly | Cys | Xaa' | Tyr | (SEQ ID NO: 506) |
| Cys | Cys | Xaa' | Glu | Tyr | Cys | Cys | Xaa' | Asn | Pro | Ala | Xaa' | Cys | Thr | Gly | Cys | Tyr | (SEQ ID NO: 507) |
| Cys | Cys | Xaa' | Glu | Tyr | Cys | Cys | Xaa' | Asn | Pro | Ala | Xaa' | Cys | Xaa' | Thr | Gly | Cys | Tyr | (SEQ ID NO: 508) |
| Cys | Cys | Xaa' | Glu | Tyr | Cys | Cys | Xaa' | Asn | Pro | Ala | Xaa' | Cys | Thr | Xaa' | Gly | Cys | Tyr | (SEQ ID NO: 509) |
| Cys | Cys | Xaa' | Glu | Tyr | Cys | Cys | Xaa' | Asn | Pro | Ala | Xaa' | Cys | Thr | Gly | Xaa' | Cys | Tyr | (SEQ ID NO: 510) |
| Cys | Cys | Xaa' | Glu | Tyr | Cys | Cys | Xaa' | Asn | Pro | Ala | Xaa' | Cys | Thr | Gly | Cys | Xaa' | Tyr | (SEQ ID NO: 511) |
| Cys | Cys | Xaa' | Glu | Tyr | Cys | Cys | Xaa' | Ala | Xaa' | Cys | Thr | Gly | Cys | Tyr | (SEQ ID NO: 512) |
| Cys | Cys | Xaa' | Glu | Tyr | Cys | Cys | Xaa' | Ala | Xaa' | Cys | Xaa' | Thr | Gly | Cys | Tyr | (SEQ ID NO: 513) |
| Cys | Cys | Xaa' | Glu | Tyr | Cys | Cys | Xaa' | Ala | Xaa' | Cys | Thr | Xaa' | Gly | Cys | Tyr | (SEQ ID NO: 514) |
| Cys | Cys | Xaa' | Glu | Tyr | Cys | Cys | Xaa' | Ala | Xaa' | Cys | Thr | Gly | Xaa' | Cys | Tyr | (SEQ ID NO: 515) |
| Cys | Cys | Xaa' | Glu | Tyr | Cys | Cys | Xaa' | Ala | Xaa' | Cys | Thr | Gly | Cys | Xaa' | Tyr | (SEQ ID NO: 516) |
| Cys | Cys | Xaa' | Glu | Tyr | Cys | Cys | Xaa' | Asn | Pro | Ala | Xaa' | Cys | Thr | Gly | Cys | Tyr | (SEQ ID NO: 517) |
| Cys | Cys | Xaa' | Glu | Tyr | Cys | Cys | Xaa' | Asn | Pro | Ala | Xaa' | Cys | Xaa' | Thr | Gly | Cys | Tyr | (SEQ ID NO: 518) |
| Cys | Cys | Xaa' | Glu | Tyr | Cys | Cys | Xaa' | Asn | Pro | Ala | Xaa' | Cys | Thr | Xaa' | Gly | Cys | Tyr | (SEQ ID NO: 519) |
| Cys | Cys | Xaa' | Glu | Tyr | Cys | Cys | Xaa' | Asn | Pro | Ala | Xaa' | Cys | Thr | Gly | Xaa' | Cys | Tyr | (SEQ ID NO: 520) |
| Cys | Cys | Xaa' | Glu | Tyr | Cys | Cys | Xaa' | Asn | Pro | Ala | Xaa' | Cys | Thr | Gly | Cys | Xaa' | Tyr | (SEQ ID NO: 521) |
| Cys | Cys | Xaa' | Glu | Tyr | Cys | Cys | Xaa' | Asn | Pro | Ala | Cys | Xaa' | Thr | Gly | Cys | Tyr | (SEQ ID NO: 522) |
| Cys | Cys | Xaa' | Glu | Tyr | Cys | Cys | Xaa' | Asn | Pro | Ala | Cys | Xaa' | Xaa' | Thr | Gly | Cys | Tyr | (SEQ ID NO: 523) |
| Cys | Cys | Xaa' | Glu | Tyr | Cys | Cys | Xaa' | Asn | Pro | Ala | Cys | Xaa' | Thr | Xaa' | Gly | Cys | Tyr | (SEQ ID NO: 524) |
| Cys | Cys | Xaa' | Glu | Tyr | Cys | Cys | Xaa' | Asn | Pro | Ala | Cys | Xaa' | Thr | Gly | Xaa' | Cys | Tyr | (SEQ ID NO: 525) |
| Cys | Cys | Xaa' | Glu | Tyr | Cys | Cys | Xaa' | Asn | Pro | Ala | Cys | Xaa' | Thr | Gly | Cys | Xaa' | Tyr | (SEQ ID NO: 526) |

| | | | | | | | | | | | | | |
|---|---|---|---|---|---|---|---|---|---|---|---|---|---|
| Cys | Cys | Xaa' | Glu | Tyr | Cys | Cys | Xaa' | Asn | Pro | Ala | Cys | Xaa' | Thr | Gly | Cys | Xaa' | Tyr | (SEQ ID NO: 527) |

Cys Cys Xaa' Glu Tyr Cys Cys Xaa' Asn Pro Ala Cys Xaa' Thr Gly Cys Xaa' Tyr (SEQ ID NO: 527)
Cys Cys Xaa' Glu Tyr Cys Cys Xaa' Asn Pro Ala Cys Thr Gly Cys Tyr (SEQ ID NO: 528)
Cys Cys Xaa' Glu Tyr Cys Cys Xaa' Asn Pro Ala Cys Thr Xaa' Gly Cys Tyr (SEQ ID NO: 529)
Cys Cys Xaa' Glu Tyr Cys Cys Xaa' Asn Pro Ala Cys Xaa' Gly Cys Tyr (SEQ ID NO: 530)
Cys Cys Xaa' Glu Tyr Cys Cys Xaa' Asn Pro Ala Cys Thr Xaa' Gly Cys Xaa' Tyr (SEQ ID NO: 531)
Cys Cys Xaa' Glu Tyr Cys Cys Xaa' Asn Pro Ala Cys Thr Gly Xaa' Cys Tyr (SEQ ID NO: 532)
Cys Cys Xaa' Glu Tyr Cys Cys Xaa' Asn Pro Ala Cys Thr Gly Cys Xaa' Tyr (SEQ ID NO: 533)
Cys Cys Xaa' Glu Tyr Cys Cys Xaa' Asn Pro Ala Cys Xaa' Thr Xaa' Gly Xaa' Cys Tyr (SEQ ID NO: 534)
Cys Cys Xaa' Glu Tyr Cys Cys Xaa' Asn Pro Ala Cys Xaa' Thr Xaa' Gly Cys Xaa' Tyr (SEQ ID NO: 535)
Cys Cys Xaa' Glu Tyr Cys Cys Xaa' Asn Pro Ala Cys Xaa' Thr Gly Xaa' Cys Xaa' Tyr (SEQ ID NO: 536)
Cys Cys Xaa' Glu Tyr Cys Cys Asn Xaa' Pro Ala Cys Thr Gly Cys Tyr (SEQ ID NO: 537)
Cys Cys Xaa' Glu Tyr Cys Cys Asn Xaa' Xaa' Pro Ala Cys Thr Gly Cys Tyr (SEQ ID NO: 538)
Cys Cys Xaa' Glu Tyr Cys Cys Asn Xaa' Xaa' Pro Ala Cys Thr Gly Cys Tyr (SEQ ID NO: 539)
Cys Cys Xaa' Glu Tyr Cys Cys Asn Xaa' Xaa' Pro Xaa' Ala Cys Thr Gly Cys Tyr (SEQ ID NO: 540)
Cys Cys Xaa' Glu Tyr Cys Cys Asn Xaa' Xaa' Pro Xaa' Ala Cys Xaa' Thr Gly Cys Tyr (SEQ ID NO: 541)
Cys Cys Xaa' Glu Tyr Cys Cys Asn Xaa' Xaa' Pro Ala Cys Xaa' Thr Gly Cys Tyr (SEQ ID NO: 542)
Cys Cys Xaa' Glu Tyr Cys Cys Asn Xaa' Xaa' Pro Ala Cys Thr Xaa' Gly Cys Tyr (SEQ ID NO: 543)
Cys Cys Xaa' Glu Tyr Cys Cys Asn Xaa' Xaa' Pro Ala Cys Thr Gly Xaa' Cys Tyr (SEQ ID NO: 544)
Cys Cys Xaa' Glu Tyr Cys Cys Asn Xaa' Xaa' Pro Ala Cys Thr Gly Cys Xaa' Tyr (SEQ ID NO: 545)
Cys Cys Xaa' Glu Tyr Cys Cys Asn Xaa' Xaa' Pro Ala Cys Xaa' Thr Gly Cys Xaa' Tyr (SEQ ID NO: 546)
Cys Cys Xaa' Glu Tyr Cys Cys Asn Xaa' Xaa' Pro Ala Xaa' Cys Thr Gly Cys Tyr (SEQ ID NO: 547)
Cys Cys Xaa' Glu Tyr Cys Cys Asn Xaa' Xaa' Pro Ala Xaa' Cys Xaa' Thr Gly Cys Tyr (SEQ ID NO: 548)
Cys Cys Xaa' Glu Tyr Cys Cys Asn Xaa' Xaa' Pro Ala Xaa' Cys Thr Xaa' Gly Cys Tyr (SEQ ID NO: 549)
Cys Cys Xaa' Glu Tyr Cys Cys Asn Xaa' Xaa' Pro Ala Xaa' Cys Thr Gly Xaa' Cys Tyr (SEQ ID NO: 550)
Cys Cys Xaa' Glu Tyr Cys Cys Asn Xaa' Xaa' Pro Ala Xaa' Cys Thr Gly Cys Xaa' Tyr (SEQ ID NO: 551)
Cys Cys Xaa' Glu Tyr Cys Cys Asn Xaa' Xaa' Pro Ala Xaa' Cys Xaa' Thr Gly Cys Xaa' Tyr (SEQ ID NO: 552)
Cys Cys Xaa' Glu Tyr Cys Cys Asn Xaa' Pro Ala Xaa' Cys Thr Gly Cys Tyr (SEQ ID NO: 553)
Cys Cys Xaa' Glu Tyr Cys Cys Asn Xaa' Pro Xaa' Ala Xaa' Cys Thr Gly Cys Tyr (SEQ ID NO: 554)
Cys Cys Xaa' Glu Tyr Cys Cys Asn Xaa' Pro Ala Xaa' Cys Xaa' Thr Gly Cys Tyr (SEQ ID NO: 555)

| | | | | | | | | | | | | |
|---|---|---|---|---|---|---|---|---|---|---|---|---|
| Cys Cys Xaa' | Glu Tyr | Cys Cys | Asn Xaa' | Pro Ala | Xaa' Cys | Thr Xaa' | Gly Cys | Tyr | (SEQ ID NO: 556) |
| Cys Cys Xaa' | Glu Tyr | Cys Cys | Asn Xaa' | Pro Ala | Xaa' Cys | Thr Gly | Xaa' Cys | Tyr | (SEQ ID NO: 557) |
| Cys Cys Xaa' | Glu Tyr | Cys Cys | Asn Xaa' | Pro Ala | Xaa' Cys | Thr Gly | Cys Xaa' | Tyr | (SEQ ID NO: 558) |
| Cys Cys Xaa' | Glu Tyr | Cys Cys | Asn Xaa' | Pro Ala | Xaa' Cys | Thr Gly | Cys Tyr | | (SEQ ID NO: 559) |
| Cys Cys Xaa' | Glu Tyr | Cys Cys | Asn Xaa' | Pro Ala | Cys Xaa' | Xaa' Thr | Gly Cys | Tyr | (SEQ ID NO: 560) |
| Cys Cys Xaa' | Glu Tyr | Cys Cys | Asn Xaa' | Pro Ala | Cys Xaa' | Thr Xaa' | Gly Cys | Tyr | (SEQ ID NO: 561) |
| Cys Cys Xaa' | Glu Tyr | Cys Cys | Asn Xaa' | Pro Ala | Cys Xaa' | Thr Gly | Xaa' Cys | Tyr | (SEQ ID NO: 562) |
| Cys Cys Xaa' | Glu Tyr | Cys Cys | Asn Xaa' | Pro Ala | Cys Xaa' | Thr Gly | Cys Xaa' | Tyr | (SEQ ID NO: 563) |
| Cys Cys Xaa' | Glu Tyr | Cys Cys | Asn Xaa' | Pro Ala | Cys Thr | Xaa' Xaa' | Gly Cys | Tyr | (SEQ ID NO: 564) |
| Cys Cys Xaa' | Glu Tyr | Cys Cys | Asn Xaa' | Pro Ala | Cys Thr | Xaa' Gly | Xaa' Cys | Tyr | (SEQ ID NO: 565) |
| Cys Cys Xaa' | Glu Tyr | Cys Cys | Asn Xaa' | Pro Ala | Cys Thr | Xaa' Gly | Cys Xaa' | Tyr | (SEQ ID NO: 566) |
| Cys Cys Xaa' | Glu Tyr | Cys Cys | Asn Xaa' | Pro Ala | Cys Thr | Gly Xaa' | Cys Xaa' | Tyr | (SEQ ID NO: 567) |
| Cys Cys Xaa' | Glu Tyr | Cys Cys | Asn Xaa' | Pro Ala | Cys Thr | Gly Cys | Xaa' Tyr | | (SEQ ID NO: 568) |
| Cys Cys Xaa' | Glu Tyr | Cys Cys | Asn Xaa' | Pro Xaa' | Xaa' Ala | Cys Thr | Gly Cys | Tyr | (SEQ ID NO: 569) |
| Cys Cys Xaa' | Glu Tyr | Cys Cys | Asn Xaa' | Pro Xaa' | Ala Cys | Xaa' Thr | Gly Cys | Tyr | (SEQ ID NO: 570) |
| Cys Cys Xaa' | Glu Tyr | Cys Cys | Asn Xaa' | Pro Xaa' | Ala Cys | Thr Xaa' | Cys Xaa' | Tyr | (SEQ ID NO: 571) |
| Cys Cys Xaa' | Glu Tyr | Cys Cys | Asn Xaa' | Pro Xaa' | Ala Cys | Thr Gly | Cys Xaa' | Tyr | (SEQ ID NO: 572) |
| Cys Cys Xaa' | Glu Tyr | Cys Cys | Asn Xaa' | Pro Xaa' | Ala Cys | Thr Gly | Cys Tyr | | (SEQ ID NO: 573) |
| Cys Cys Xaa' | Glu Tyr | Cys Cys | Asn Pro | Xaa' Ala | Xaa' Cys | Thr Gly | Cys Tyr | | (SEQ ID NO: 574) |
| Cys Cys Xaa' | Glu Tyr | Cys Cys | Asn Pro | Xaa' Ala | Cys Xaa' | Thr Gly | Cys Tyr | | (SEQ ID NO: 575) |
| Cys Cys Xaa' | Glu Tyr | Cys Cys | Asn Pro | Xaa' Ala | Cys Thr | Xaa' Gly | Cys Tyr | | (SEQ ID NO: 576) |
| Cys Cys Xaa' | Glu Tyr | Cys Cys | Asn Pro | Xaa' Ala | Cys Thr | Gly Xaa' | Cys Tyr | | (SEQ ID NO: 577) |
| Cys Cys Xaa' | Glu Tyr | Cys Cys | Asn Pro | Xaa' Ala | Cys Thr | Gly Cys | Xaa' Tyr | | (SEQ ID NO: 578) |
| Cys Cys Xaa' | Glu Tyr | Cys Cys | Asn Pro | Ala Xaa' | Xaa' Cys | Thr Gly | Cys Tyr | | (SEQ ID NO: 579) |
| Cys Cys Xaa' | Glu Tyr | Cys Cys | Asn Pro | Ala Xaa' | Cys Xaa' | Thr Gly | Cys Tyr | | (SEQ ID NO: 580) |
| Cys Cys Xaa' | Glu Tyr | Cys Cys | Asn Pro | Ala Xaa' | Cys Thr | Xaa' Gly | Cys Tyr | | (SEQ ID NO: 581) |
| Cys Cys Xaa' | Glu Tyr | Cys Cys | Asn Pro | Ala Xaa' | Cys Xaa' | Thr Gly | Cys Tyr | | (SEQ ID NO: 582) |
| Cys Cys Xaa' | Glu Tyr | Cys Cys | Asn Pro | Ala Xaa' | Cys Thr | Gly Cys | Xaa' Tyr | | (SEQ ID NO: 583) |
| Cys Cys Xaa' | Glu Tyr | Cys Cys | Asn Pro | Ala Xaa' | Cys Thr | Xaa' Gly | Cys Tyr | | (SEQ ID NO: 584) |

FIG. 12-9

Cys Cys Xaa' Glu Tyr Cys Cys Asn Pro Xaa' Ala Xaa' Cys Thr Gly Xaa' Cys Tyr (SEQ ID NO: 585)
Cys Cys Xaa' Glu Tyr Cys Cys Asn Pro Xaa' Ala Xaa' Cys Thr Gly Cys Xaa' Tyr (SEQ ID NO: 586)
Cys Cys Xaa' Glu Tyr Cys Cys Asn Pro Xaa' Ala Cys Xaa' Thr Gly Cys Tyr (SEQ ID NO: 587)
Cys Cys Xaa' Glu Tyr Cys Cys Asn Pro Xaa' Ala Cys Xaa' Xaa' Thr Gly Cys Tyr (SEQ ID NO: 588)
Cys Cys Xaa' Glu Tyr Cys Cys Asn Pro Xaa' Ala Cys Xaa' Thr Xaa' Gly Cys Tyr (SEQ ID NO: 589)
Cys Cys Xaa' Glu Tyr Cys Cys Asn Pro Xaa' Ala Cys Xaa' Thr Gly Xaa' Cys Tyr (SEQ ID NO: 590)
Cys Cys Xaa' Glu Tyr Cys Cys Asn Pro Xaa' Ala Cys Xaa' Thr Gly Cys Xaa' Tyr (SEQ ID NO: 591)
Cys Cys Xaa' Glu Tyr Cys Cys Asn Pro Xaa' Ala Cys Thr Xaa' Gly Cys Tyr (SEQ ID NO: 592)
Cys Cys Xaa' Glu Tyr Cys Cys Asn Pro Xaa' Ala Cys Thr Xaa' Xaa' Gly Cys Tyr (SEQ ID NO: 593)
Cys Cys Xaa' Glu Tyr Cys Cys Asn Pro Xaa' Ala Cys Thr Xaa' Gly Xaa' Cys Tyr (SEQ ID NO: 594)
Cys Cys Xaa' Glu Tyr Cys Cys Asn Pro Xaa' Ala Cys Thr Xaa' Gly Cys Xaa' Tyr (SEQ ID NO: 595)
Cys Cys Xaa' Glu Tyr Cys Cys Asn Pro Xaa' Ala Cys Thr Gly Xaa' Cys Tyr (SEQ ID NO: 596)
Cys Cys Xaa' Glu Tyr Cys Cys Asn Pro Xaa' Ala Cys Thr Gly Xaa' Xaa' Cys Tyr (SEQ ID NO: 597)
Cys Cys Xaa' Glu Tyr Cys Cys Asn Pro Xaa' Ala Cys Thr Gly Xaa' Cys Xaa' Tyr (SEQ ID NO: 598)
Cys Cys Xaa' Glu Tyr Cys Cys Asn Pro Xaa' Ala Cys Thr Gly Cys Xaa' Xaa' Tyr (SEQ ID NO: 599)
Cys Cys Xaa' Glu Tyr Cys Cys Asn Pro Ala Xaa' Cys Thr Gly Cys Tyr (SEQ ID NO: 600)
Cys Cys Xaa' Glu Tyr Cys Cys Asn Pro Ala Xaa' Xaa' Cys Thr Gly Cys Tyr (SEQ ID NO: 601)
Cys Cys Xaa' Glu Tyr Cys Cys Asn Pro Ala Xaa' Cys Xaa' Thr Gly Cys Tyr (SEQ ID NO: 602)
Cys Cys Xaa' Glu Tyr Cys Cys Asn Pro Ala Xaa' Cys Thr Xaa' Gly Cys Tyr (SEQ ID NO: 603)
Cys Cys Xaa' Glu Tyr Cys Cys Asn Pro Ala Xaa' Cys Thr Xaa' Gly Cys Tyr (SEQ ID NO: 604)
Cys Cys Xaa' Glu Tyr Cys Cys Asn Pro Ala Xaa' Cys Thr Gly Xaa' Cys Tyr (SEQ ID NO: 605)
Cys Cys Xaa' Glu Tyr Cys Cys Asn Pro Ala Xaa' Cys Thr Gly Cys Xaa' Tyr (SEQ ID NO: 606)
Cys Cys Xaa' Glu Tyr Cys Cys Asn Pro Ala Cys Xaa' Thr Gly Cys Tyr (SEQ ID NO: 607)
Cys Cys Xaa' Glu Tyr Cys Cys Asn Pro Ala Cys Xaa' Xaa' Thr Gly Cys Tyr (SEQ ID NO: 608)
Cys Cys Xaa' Glu Tyr Cys Cys Asn Pro Ala Cys Xaa' Thr Xaa' Gly Cys Tyr (SEQ ID NO: 609)
Cys Cys Xaa' Glu Tyr Cys Cys Asn Pro Ala Cys Xaa' Thr Gly Xaa' Cys Tyr (SEQ ID NO: 610)
Cys Cys Xaa' Glu Tyr Cys Cys Asn Pro Ala Cys Xaa' Thr Gly Cys Xaa' Tyr (SEQ ID NO: 611)
Cys Cys Xaa' Glu Tyr Cys Cys Asn Pro Ala Cys Thr Xaa' Gly Cys Tyr (SEQ ID NO: 612)
Cys Cys Xaa' Glu Tyr Cys Cys Asn Pro Ala Cys Thr Xaa' Gly Cys Tyr (SEQ ID NO: 613)

*FIG. 12-10*

```
Cys Cys Xaa' Glu Tyr Cys Cys Asn Pro Ala Cys Thr Xaa' Xaa' Gly Cys Tyr    (SEQ ID NO: 614)
Cys Cys Xaa' Glu Tyr Cys Cys Asn Pro Ala Cys Thr Xaa' Gly Xaa' Cys Tyr    (SEQ ID NO: 615)
Cys Cys Xaa' Glu Tyr Cys Cys Asn Pro Ala Cys Thr Xaa' Gly Cys Xaa' Tyr    (SEQ ID NO: 616)
Cys Cys Xaa' Glu Tyr Cys Cys Asn Pro Ala Cys Thr Gly Xaa' Cys Tyr         (SEQ ID NO: 617)
Cys Cys Xaa' Glu Tyr Cys Cys Asn Pro Ala Xaa' Cys Thr Gly Xaa' Cys Tyr    (SEQ ID NO: 618)
Cys Cys Xaa' Glu Tyr Cys Cys Asn Pro Ala Xaa' Cys Thr Gly Cys Xaa' Tyr    (SEQ ID NO: 619)
Cys Cys Xaa' Glu Tyr Cys Cys Asn Pro Ala Xaa' Cys Thr Gly Cys Xaa' Tyr    (SEQ ID NO: 620)
Cys Cys Xaa' Glu Tyr Cys Cys Asn Pro Ala Xaa' Cys Thr Gly Cys Xaa' Tyr    (SEQ ID NO: 621)
Cys Cys Xaa' Glu Tyr Cys Cys Asn Pro Ala Cys Xaa' Thr Gly Cys Tyr         (SEQ ID NO: 622)
Cys Cys Xaa' Glu Tyr Cys Cys Asn Pro Ala Cys Xaa' Xaa' Thr Gly Cys Tyr    (SEQ ID NO: 623)
Cys Cys Xaa' Glu Tyr Cys Cys Asn Pro Ala Cys Xaa' Xaa' Thr Gly Cys Tyr    (SEQ ID NO: 624)
Cys Cys Xaa' Glu Tyr Cys Cys Asn Pro Ala Cys Xaa' Thr Xaa' Gly Cys Tyr    (SEQ ID NO: 625)
Cys Cys Xaa' Glu Tyr Cys Cys Asn Pro Ala Cys Xaa' Thr Gly Xaa' Cys Tyr    (SEQ ID NO: 626)
Cys Cys Xaa' Glu Tyr Cys Cys Asn Pro Ala Cys Xaa' Thr Gly Cys Xaa' Tyr    (SEQ ID NO: 627)
Cys Cys Xaa' Glu Tyr Cys Cys Asn Pro Ala Cys Xaa' Thr Gly Cys Xaa' Tyr    (SEQ ID NO: 628)
Cys Cys Xaa' Glu Tyr Cys Cys Asn Pro Ala Cys Xaa' Xaa' Gly Cys Tyr        (SEQ ID NO: 629)
Cys Cys Xaa' Glu Tyr Cys Cys Asn Pro Ala Cys Xaa' Xaa' Gly Xaa' Cys Tyr   (SEQ ID NO: 630)
Cys Cys Xaa' Glu Tyr Cys Cys Asn Pro Ala Cys Xaa' Xaa' Gly Cys Xaa' Tyr   (SEQ ID NO: 631)
Cys Cys Xaa' Glu Tyr Cys Cys Asn Pro Ala Cys Xaa' Thr Gly Cys Tyr         (SEQ ID NO: 632)
Cys Cys Xaa' Glu Tyr Cys Cys Asn Pro Ala Cys Xaa' Thr Gly Xaa' Cys Tyr    (SEQ ID NO: 633)
Cys Cys Xaa' Glu Tyr Cys Cys Asn Pro Ala Cys Xaa' Thr Gly Cys Xaa' Tyr    (SEQ ID NO: 634)
Cys Cys Xaa' Glu Tyr Cys Cys Asn Pro Ala Cys Xaa' Thr Gly Cys Xaa' Tyr    (SEQ ID NO: 635)
Cys Cys Xaa' Glu Tyr Cys Cys Asn Pro Ala Cys Thr Xaa' Gly Cys Tyr         (SEQ ID NO: 636)
Cys Cys Xaa' Glu Tyr Cys Cys Asn Pro Ala Cys Thr Xaa' Xaa' Gly Cys Tyr    (SEQ ID NO: 637)
Cys Cys Xaa' Glu Tyr Cys Cys Asn Pro Ala Cys Thr Xaa' Xaa' Gly Cys Tyr    (SEQ ID NO: 638)
Cys Cys Xaa' Glu Tyr Cys Cys Asn Pro Ala Cys Thr Xaa' Xaa' Gly Xaa' Cys Tyr (SEQ ID NO: 639)
Cys Cys Xaa' Glu Tyr Cys Cys Asn Pro Ala Cys Thr Xaa' Xaa' Gly Cys Xaa' Tyr (SEQ ID NO: 640)
Cys Cys Xaa' Glu Tyr Cys Cys Asn Pro Ala Cys Thr Xaa' Gly Cys Xaa' Tyr    (SEQ ID NO: 641)
Cys Cys Xaa' Glu Tyr Cys Cys Asn Pro Ala Cys Thr Xaa' Gly Xaa' Cys Tyr    (SEQ ID NO: 642)
```

FIG. 12-11

Cys Cys Xaa' Glu Tyr Cys Cys Asn Pro Ala Cys Thr Xaa' Gly Xaa' Xaa' Cys Tyr (SEQ ID NO: 643)
Cys Cys Xaa' Glu Tyr Cys Cys Asn Pro Ala Cys Thr Xaa' Gly Xaa' Cys Xaa' Tyr (SEQ ID NO: 644)
Cys Cys Xaa' Glu Tyr Cys Cys Asn Pro Ala Cys Thr Xaa' Gly Cys Xaa' Xaa' Tyr (SEQ ID NO: 645)
Cys Cys Xaa' Glu Tyr Cys Cys Asn Pro Ala Cys Thr Xaa' Gly Cys Xaa' Xaa' Tyr (SEQ ID NO: 646)
Cys Cys Xaa' Glu Tyr Cys Cys Asn Pro Ala Cys Thr Gly Xaa' Xaa' Cys Tyr (SEQ ID NO: 647)
Cys Cys Xaa' Glu Tyr Cys Cys Asn Pro Ala Cys Thr Gly Xaa' Xaa' Cys Tyr (SEQ ID NO: 648)
Cys Cys Xaa' Glu Tyr Cys Cys Asn Pro Ala Cys Thr Gly Xaa' Xaa' Cys Tyr (SEQ ID NO: 649)
Cys Cys Xaa' Glu Tyr Cys Cys Asn Pro Ala Cys Thr Gly Xaa' Cys Xaa' Tyr (SEQ ID NO: 650)
Cys Cys Xaa' Glu Tyr Cys Cys Asn Pro Ala Cys Thr Gly Xaa' Cys Xaa' Tyr (SEQ ID NO: 651)
Cys Cys Xaa' Glu Tyr Cys Cys Asn Pro Ala Cys Thr Gly Xaa' Cys Xaa' Tyr (SEQ ID NO: 652)
Cys Cys Xaa' Glu Tyr Cys Cys Asn Pro Ala Cys Thr Gly Cys Xaa' Xaa' Tyr (SEQ ID NO: 653)
Cys Cys Xaa' Glu Tyr Cys Cys Asn Pro Ala Cys Thr Gly Cys Xaa' Xaa' Tyr (SEQ ID NO: 654)
Cys Cys Xaa' Glu Tyr Cys Cys Asn Pro Ala Cys Thr Gly Cys Xaa' Xaa' Tyr (SEQ ID NO: 655)
Cys Cys Glu Xaa' Tyr Cys Cys Asn Pro Ala Cys Thr Gly Cys Tyr (SEQ ID NO: 656)
Cys Cys Glu Xaa' Xaa' Tyr Cys Cys Asn Pro Ala Cys Thr Gly Cys Tyr (SEQ ID NO: 657)
Cys Cys Glu Xaa' Xaa' Xaa' Tyr Cys Cys Asn Pro Ala Cys Thr Gly Cys Tyr (SEQ ID NO: 658)
Cys Cys Glu Xaa' Xaa' Xaa' Tyr Cys Cys Asn Pro Ala Cys Thr Gly Cys Tyr (SEQ ID NO: 659)
Cys Cys Glu Xaa' Xaa' Xaa' Tyr Cys Cys Xaa' Asn Pro Ala Cys Thr Gly Cys Tyr (SEQ ID NO: 660)
Cys Cys Glu Xaa' Xaa' Xaa' Tyr Cys Cys Xaa' Asn Pro Ala Cys Thr Gly Cys Tyr (SEQ ID NO: 661)
Cys Cys Glu Xaa' Xaa' Xaa' Tyr Cys Cys Xaa' Asn Pro Ala Cys Thr Gly Cys Tyr (SEQ ID NO: 662)
Cys Cys Glu Xaa' Xaa' Xaa' Tyr Cys Cys Cys Asn Pro Xaa' Ala Cys Thr Gly Cys Tyr (SEQ ID NO: 663)
Cys Cys Glu Xaa' Xaa' Xaa' Tyr Cys Cys Cys Asn Pro Ala Xaa' Cys Thr Gly Cys Tyr (SEQ ID NO: 664)
Cys Cys Glu Xaa' Xaa' Xaa' Tyr Cys Cys Cys Asn Pro Ala Cys Xaa' Thr Gly Cys Tyr (SEQ ID NO: 665)
Cys Cys Glu Xaa' Xaa' Xaa' Tyr Cys Cys Cys Asn Pro Ala Cys Thr Xaa' Gly Cys Tyr (SEQ ID NO: 666)
Cys Cys Glu Xaa' Xaa' Xaa' Tyr Cys Cys Cys Asn Pro Ala Cys Thr Gly Xaa' Cys Tyr (SEQ ID NO: 667)
Cys Cys Glu Xaa' Xaa' Tyr Xaa' Cys Cys Cys Asn Pro Ala Cys Thr Gly Cys Xaa' Tyr (SEQ ID NO: 668)
Cys Cys Glu Xaa' Tyr Xaa' Xaa' Cys Cys Cys Asn Pro Ala Cys Thr Gly Xaa' Cys Tyr (SEQ ID NO: 669)
Cys Cys Glu Xaa' Tyr Xaa' Xaa' Cys Cys Xaa' Cys Asn Pro Ala Cys Thr Gly Cys Tyr (SEQ ID NO: 670)
Cys Cys Glu Xaa' Xaa' Tyr Xaa' Cys Cys Xaa' Asn Pro Ala Cys Thr Gly Cys Tyr (SEQ ID NO: 671)

FIG. 12-12

| | | | | | | | | | | |
|---|---|---|---|---|---|---|---|---|---|---|
| Cys | Cys | Glu | Xaa' | Tyr | Xaa' | Cys | Cys | Asn | Xaa' | Pro | Ala | Cys | Thr | Gly | Cys | Tyr | (SEQ ID NO: 672) |
| Cys | Cys | Glu | Xaa' | Tyr | Xaa' | Cys | Cys | Asn | Pro | Xaa' | Ala | Cys | Thr | Gly | Cys | Tyr | (SEQ ID NO: 673) |
| Cys | Cys | Glu | Xaa' | Tyr | Xaa' | Cys | Cys | Asn | Pro | Ala | Xaa' | Cys | Thr | Gly | Cys | Tyr | (SEQ ID NO: 674) |
| Cys | Cys | Glu | Xaa' | Tyr | Xaa' | Cys | Cys | Asn | Pro | Ala | Xaa' | Cys | Thr | Gly | Cys | Tyr | (SEQ ID NO: 675) |
| Cys | Cys | Glu | Xaa' | Tyr | Xaa' | Cys | Cys | Asn | Pro | Ala | Cys | Thr | Xaa' | Gly | Cys | Tyr | (SEQ ID NO: 676) |
| Cys | Cys | Glu | Xaa' | Tyr | Xaa' | Cys | Cys | Asn | Pro | Ala | Cys | Thr | Gly | Xaa' | Cys | Tyr | (SEQ ID NO: 677) |
| Cys | Cys | Glu | Xaa' | Tyr | Xaa' | Cys | Cys | Asn | Pro | Ala | Cys | Thr | Gly | Cys | Xaa' | Tyr | (SEQ ID NO: 678) |
| Cys | Cys | Glu | Xaa' | Tyr | Cys | Cys | Xaa' | Asn | Pro | Ala | Cys | Thr | Gly | Cys | Tyr | | (SEQ ID NO: 679) |
| Cys | Cys | Glu | Xaa' | Tyr | Cys | Cys | Xaa' | Asn | Pro | Ala | Cys | Thr | Gly | Cys | Tyr | | (SEQ ID NO: 680) |
| Cys | Cys | Glu | Xaa' | Tyr | Cys | Cys | Xaa' | Asn | Xaa' | Pro | Ala | Cys | Thr | Gly | Cys | Tyr | (SEQ ID NO: 681) |
| Cys | Cys | Glu | Xaa' | Tyr | Cys | Cys | Xaa' | Asn | Pro | Xaa' | Ala | Cys | Thr | Gly | Cys | Tyr | (SEQ ID NO: 682) |
| Cys | Cys | Glu | Xaa' | Tyr | Cys | Cys | Xaa' | Asn | Pro | Ala | Xaa' | Cys | Thr | Gly | Cys | Tyr | (SEQ ID NO: 683) |
| Cys | Cys | Glu | Xaa' | Tyr | Cys | Cys | Xaa' | Asn | Pro | Ala | Cys | Thr | Xaa' | Gly | Cys | Tyr | (SEQ ID NO: 684) |
| Cys | Cys | Glu | Xaa' | Tyr | Cys | Cys | Xaa' | Asn | Pro | Ala | Cys | Thr | Gly | Xaa' | Cys | Tyr | (SEQ ID NO: 685) |
| Cys | Cys | Glu | Xaa' | Tyr | Cys | Cys | Xaa' | Asn | Pro | Ala | Cys | Thr | Gly | Cys | Xaa' | Tyr | (SEQ ID NO: 686) |
| Cys | Cys | Glu | Xaa' | Tyr | Cys | Cys | Asn | Xaa' | Pro | Ala | Cys | Thr | Gly | Cys | Tyr | | (SEQ ID NO: 687) |
| Cys | Cys | Glu | Xaa' | Tyr | Cys | Cys | Asn | Xaa' | Pro | Ala | Cys | Thr | Gly | Cys | Tyr | | (SEQ ID NO: 688) |
| Cys | Cys | Glu | Xaa' | Tyr | Cys | Cys | Asn | Xaa' | Pro | Ala | Cys | Thr | Gly | Cys | Tyr | | (SEQ ID NO: 689) |
| Cys | Cys | Glu | Xaa' | Tyr | Cys | Cys | Asn | Xaa' | Pro | Xaa' | Ala | Cys | Thr | Gly | Cys | Tyr | (SEQ ID NO: 690) |
| Cys | Cys | Glu | Xaa' | Tyr | Cys | Cys | Asn | Xaa' | Pro | Ala | Xaa' | Cys | Thr | Gly | Cys | Tyr | (SEQ ID NO: 691) |
| Cys | Cys | Glu | Xaa' | Tyr | Cys | Cys | Asn | Xaa' | Pro | Ala | Cys | Thr | Xaa' | Gly | Cys | Tyr | (SEQ ID NO: 692) |
| Cys | Cys | Glu | Xaa' | Tyr | Cys | Cys | Asn | Xaa' | Pro | Ala | Cys | Thr | Xaa' | Gly | Cys | Tyr | (SEQ ID NO: 693) |
| Cys | Cys | Glu | Xaa' | Tyr | Cys | Cys | Asn | Xaa' | Pro | Ala | Cys | Thr | Gly | Xaa' | Cys | Tyr | (SEQ ID NO: 694) |
| Cys | Cys | Glu | Xaa' | Tyr | Cys | Cys | Asn | Xaa' | Pro | Ala | Cys | Thr | Gly | Cys | Xaa' | Tyr | (SEQ ID NO: 695) |
| Cys | Cys | Glu | Xaa' | Tyr | Cys | Cys | Asn | Pro | Xaa' | Ala | Cys | Thr | Gly | Cys | Tyr | | (SEQ ID NO: 696) |
| Cys | Cys | Glu | Xaa' | Tyr | Cys | Cys | Asn | Pro | Xaa' | Ala | Cys | Thr | Gly | Cys | Tyr | | (SEQ ID NO: 697) |
| Cys | Cys | Glu | Xaa' | Tyr | Cys | Cys | Asn | Pro | Xaa' | Ala | Xaa' | Cys | Thr | Gly | Cys | Tyr | (SEQ ID NO: 698) |
| Cys | Cys | Glu | Xaa' | Tyr | Cys | Cys | Asn | Pro | Xaa' | Ala | Cys | Thr | Xaa' | Gly | Cys | Tyr | (SEQ ID NO: 699) |
| Cys | Cys | Glu | Xaa' | Tyr | Cys | Cys | Asn | Pro | Xaa' | Ala | Cys | Thr | Xaa' | Gly | Cys | Tyr | (SEQ ID NO: 700) |

FIG. 12-13

| | | | | | | | | | | | |
|---|---|---|---|---|---|---|---|---|---|---|---|
| Cys | Cys | Glu | Xaa' | Xaa' | Tyr | Cys | Cys | Asn | Pro | Xaa' | Ala | Cys | Thr | Gly | Xaa' | Cys | Tyr | (SEQ ID NO: 701) |
| Cys | Cys | Glu | Xaa' | Xaa' | Tyr | Cys | Cys | Asn | Pro | Xaa' | Ala | Cys | Thr | Gly | Cys | Xaa' | Tyr | (SEQ ID NO: 702) |
| Cys | Cys | Glu | Xaa' | Xaa' | Tyr | Cys | Cys | Asn | Pro | Ala | Xaa' | Cys | Thr | Gly | Cys | Tyr | | (SEQ ID NO: 703) |
| Cys | Cys | Glu | Xaa' | Xaa' | Tyr | Cys | Cys | Xaa' | Xaa' | Cys | Thr | Gly | Cys | Tyr | | | | (SEQ ID NO: 704) |
| Cys | Cys | Glu | Xaa' | Xaa' | Tyr | Cys | Cys | Asn | Pro | Ala | Xaa' | Cys | Xaa' | Thr | Gly | Cys | Tyr | (SEQ ID NO: 705) |
| Cys | Cys | Glu | Xaa' | Xaa' | Tyr | Cys | Cys | Asn | Pro | Ala | Xaa' | Cys | Thr | Xaa' | Gly | Cys | Tyr | (SEQ ID NO: 706) |
| Cys | Cys | Glu | Xaa' | Xaa' | Tyr | Cys | Cys | Asn | Pro | Ala | Xaa' | Cys | Thr | Gly | Xaa' | Cys | Tyr | (SEQ ID NO: 707) |
| Cys | Cys | Glu | Xaa' | Xaa' | Tyr | Cys | Cys | Asn | Pro | Ala | Xaa' | Cys | Thr | Gly | Cys | Xaa' | Tyr | (SEQ ID NO: 708) |
| Cys | Cys | Glu | Xaa' | Xaa' | Tyr | Cys | Cys | Asn | Pro | Ala | Cys | Xaa' | Thr | Gly | Cys | Tyr | | (SEQ ID NO: 709) |
| Cys | Cys | Glu | Xaa' | Xaa' | Tyr | Cys | Cys | Asn | Pro | Ala | Cys | Xaa' | Xaa' | Thr | Gly | Cys | Tyr | (SEQ ID NO: 710) |
| Cys | Cys | Glu | Xaa' | Xaa' | Tyr | Cys | Cys | Asn | Pro | Ala | Cys | Xaa' | Thr | Xaa' | Gly | Cys | Tyr | (SEQ ID NO: 711) |
| Cys | Cys | Glu | Xaa' | Xaa' | Tyr | Cys | Cys | Asn | Pro | Ala | Cys | Xaa' | Thr | Gly | Xaa' | Cys | Tyr | (SEQ ID NO: 712) |
| Cys | Cys | Glu | Xaa' | Xaa' | Tyr | Cys | Cys | Asn | Pro | Ala | Cys | Xaa' | Thr | Gly | Cys | Xaa' | Tyr | (SEQ ID NO: 713) |
| Cys | Cys | Glu | Xaa' | Xaa' | Tyr | Cys | Cys | Asn | Pro | Ala | Cys | Thr | Xaa' | Gly | Cys | Tyr | | (SEQ ID NO: 714) |
| Cys | Cys | Glu | Xaa' | Xaa' | Tyr | Cys | Cys | Asn | Pro | Ala | Cys | Thr | Xaa' | Xaa' | Gly | Cys | Tyr | (SEQ ID NO: 715) |
| Cys | Cys | Glu | Xaa' | Xaa' | Tyr | Cys | Cys | Asn | Pro | Ala | Cys | Thr | Xaa' | Gly | Xaa' | Cys | Tyr | (SEQ ID NO: 716) |
| Cys | Cys | Glu | Xaa' | Xaa' | Tyr | Cys | Cys | Asn | Pro | Ala | Cys | Thr | Xaa' | Gly | Cys | Xaa' | Tyr | (SEQ ID NO: 717) |
| Cys | Cys | Glu | Xaa' | Xaa' | Tyr | Cys | Cys | Asn | Pro | Ala | Cys | Thr | Gly | Xaa' | Cys | Tyr | | (SEQ ID NO: 718) |
| Cys | Cys | Glu | Xaa' | Xaa' | Tyr | Cys | Cys | Asn | Pro | Ala | Cys | Thr | Gly | Xaa' | Xaa' | Cys | Tyr | (SEQ ID NO: 719) |
| Cys | Cys | Glu | Xaa' | Xaa' | Tyr | Cys | Cys | Asn | Pro | Ala | Cys | Thr | Gly | Xaa' | Cys | Xaa' | Tyr | (SEQ ID NO: 720) |
| Cys | Cys | Glu | Xaa' | Xaa' | Tyr | Cys | Cys | Asn | Pro | Ala | Cys | Thr | Gly | Cys | Xaa' | Xaa' | Tyr | (SEQ ID NO: 721) |
| Cys | Cys | Glu | Xaa' | Xaa' | Tyr | Cys | Cys | Asn | Pro | Ala | Cys | Thr | Gly | Cys | Xaa' | Tyr | | (SEQ ID NO: 722) |
| Cys | Cys | Glu | Xaa' | Tyr | Xaa' | Cys | Cys | Asn | Pro | Ala | Cys | Thr | Gly | Cys | Tyr | | | (SEQ ID NO: 723) |
| Cys | Cys | Glu | Xaa' | Tyr | Xaa' | Cys | Cys | Xaa' | Asn | Pro | Ala | Cys | Thr | Gly | Cys | Tyr | | (SEQ ID NO: 724) |
| Cys | Cys | Glu | Xaa' | Tyr | Xaa' | Cys | Cys | Asn | Xaa' | Pro | Ala | Cys | Thr | Gly | Cys | Tyr | | (SEQ ID NO: 725) |
| Cys | Cys | Glu | Xaa' | Tyr | Xaa' | Cys | Cys | Asn | Pro | Xaa' | Ala | Cys | Thr | Gly | Cys | Tyr | | (SEQ ID NO: 726) |
| Cys | Cys | Glu | Xaa' | Tyr | Xaa' | Cys | Cys | Asn | Pro | Ala | Xaa' | Cys | Thr | Gly | Cys | Tyr | | (SEQ ID NO: 727) |
| Cys | Cys | Glu | Xaa' | Tyr | Xaa' | Cys | Cys | Asn | Pro | Ala | Cys | Thr | Gly | Cys | Tyr | | | (SEQ ID NO: 728) |
| Cys | Cys | Glu | Xaa' | Tyr | Xaa' | Cys | Cys | Asn | Pro | Ala | Xaa' | Cys | Thr | Gly | Cys | Tyr | | (SEQ ID NO: 729) |

FIG. 12-14

Cys Cys Glu Xaa' Tyr Xaa' Xaa' Cys Cys Asn Pro Ala Cys Xaa' Thr Gly Cys Tyr (SEQ ID NO: 730)
Cys Cys Glu Xaa' Tyr Xaa' Xaa' Cys Cys Asn Pro Ala Cys Thr Xaa' Gly Cys Tyr (SEQ ID NO: 731)
Cys Cys Glu Xaa' Tyr Xaa' Xaa' Cys Cys Asn Pro Ala Cys Thr Gly Xaa' Cys Tyr (SEQ ID NO: 732)
Cys Cys Glu Xaa' Tyr Xaa' Xaa' Cys Cys Asn Pro Ala Cys Thr Gly Cys Xaa' Tyr (SEQ ID NO: 733)
Cys Cys Glu Xaa' Tyr Xaa' Cys Cys Xaa' Asn Pro Ala Cys Thr Gly Cys Tyr (SEQ ID NO: 734)
Cys Cys Glu Xaa' Tyr Xaa' Cys Cys Xaa' Asn Pro Ala Cys Thr Gly Cys Tyr (SEQ ID NO: 735)
Cys Cys Glu Xaa' Tyr Xaa' Cys Cys Xaa' Asn Xaa' Pro Ala Cys Thr Gly Cys Tyr (SEQ ID NO: 736)
Cys Cys Glu Xaa' Tyr Xaa' Cys Cys Xaa' Asn Pro Ala Xaa' Cys Thr Gly Cys Tyr (SEQ ID NO: 737)
Cys Cys Glu Xaa' Tyr Xaa' Cys Cys Xaa' Asn Pro Ala Cys Xaa' Thr Gly Cys Tyr (SEQ ID NO: 738)
Cys Cys Glu Xaa' Tyr Xaa' Cys Cys Xaa' Asn Pro Ala Cys Thr Xaa' Gly Cys Tyr (SEQ ID NO: 739)
Cys Cys Glu Xaa' Tyr Xaa' Cys Cys Xaa' Asn Pro Ala Cys Thr Gly Xaa' Cys Tyr (SEQ ID NO: 740)
Cys Cys Glu Xaa' Tyr Xaa' Cys Cys Xaa' Asn Pro Ala Cys Thr Gly Cys Xaa' Tyr (SEQ ID NO: 741)
Cys Cys Glu Xaa' Tyr Xaa' Cys Cys Asn Xaa' Pro Ala Cys Thr Gly Cys Tyr (SEQ ID NO: 742)
Cys Cys Glu Xaa' Tyr Xaa' Cys Cys Asn Xaa' Pro Ala Cys Thr Gly Cys Tyr (SEQ ID NO: 743)
Cys Cys Glu Xaa' Tyr Xaa' Cys Cys Asn Xaa' Pro Ala Cys Thr Gly Cys Tyr (SEQ ID NO: 744)
Cys Cys Glu Xaa' Tyr Xaa' Cys Cys Asn Xaa' Pro Ala Xaa' Cys Thr Gly Cys Tyr (SEQ ID NO: 745)
Cys Cys Glu Xaa' Tyr Xaa' Cys Cys Asn Xaa' Pro Ala Cys Xaa' Thr Gly Cys Tyr (SEQ ID NO: 746)
Cys Cys Glu Xaa' Tyr Xaa' Cys Cys Asn Xaa' Pro Ala Cys Thr Xaa' Gly Cys Tyr (SEQ ID NO: 747)
Cys Cys Glu Xaa' Tyr Xaa' Cys Cys Asn Xaa' Pro Ala Cys Thr Gly Xaa' Cys Tyr (SEQ ID NO: 748)
Cys Cys Glu Xaa' Tyr Xaa' Cys Cys Asn Xaa' Pro Ala Cys Thr Gly Cys Xaa' Tyr (SEQ ID NO: 749)
Cys Cys Glu Xaa' Tyr Xaa' Cys Cys Asn Pro Xaa' Ala Cys Thr Gly Cys Tyr (SEQ ID NO: 750)
Cys Cys Glu Xaa' Tyr Xaa' Cys Cys Asn Pro Xaa' Ala Cys Thr Gly Cys Tyr (SEQ ID NO: 751)
Cys Cys Glu Xaa' Tyr Xaa' Cys Cys Asn Pro Xaa' Ala Cys Thr Gly Cys Tyr (SEQ ID NO: 752)
Cys Cys Glu Xaa' Tyr Xaa' Cys Cys Asn Pro Xaa' Ala Xaa' Cys Thr Gly Cys Tyr (SEQ ID NO: 753)
Cys Cys Glu Xaa' Tyr Xaa' Cys Cys Asn Pro Xaa' Ala Cys Xaa' Thr Gly Cys Tyr (SEQ ID NO: 754)
Cys Cys Glu Xaa' Tyr Xaa' Cys Cys Asn Pro Xaa' Ala Cys Thr Xaa' Gly Cys Tyr (SEQ ID NO: 755)
Cys Cys Glu Xaa' Tyr Xaa' Cys Cys Asn Pro Xaa' Ala Cys Thr Gly Xaa' Cys Tyr (SEQ ID NO: 756)
Cys Cys Glu Xaa' Tyr Xaa' Cys Cys Asn Pro Xaa' Ala Cys Thr Gly Cys Xaa' Tyr (SEQ ID NO: 757)
Cys Cys Glu Xaa' Tyr Xaa' Cys Cys Asn Pro Ala Xaa' Cys Thr Gly Cys Tyr (SEQ ID NO: 758)

FIG. 12-15

```
Cys Cys Glu Xaa' Tyr Xaa' Cys Cys Asn Pro Ala Xaa' Xaa' Cys Thr Gly Cys Tyr       (SEQ ID NO: 759)
Cys Cys Glu Xaa' Tyr Xaa' Cys Cys Asn Pro Ala Xaa' Xaa' Cys Xaa' Thr Gly Cys Tyr   (SEQ ID NO: 760)
Cys Cys Glu Xaa' Tyr Xaa' Cys Cys Asn Pro Ala Xaa' Cys Thr Xaa' Gly Cys Tyr        (SEQ ID NO: 761)
Cys Cys Glu Xaa' Tyr Xaa' Cys Cys Asn Pro Ala Xaa' Cys Thr Gly Xaa' Cys Tyr        (SEQ ID NO: 762)
Cys Cys Glu Xaa' Tyr Xaa' Cys Cys Asn Pro Ala Xaa' Cys Thr Gly Cys Xaa' Tyr        (SEQ ID NO: 763)
Cys Cys Glu Xaa' Tyr Xaa' Cys Cys Asn Pro Ala Cys Xaa' Thr Gly Cys Tyr             (SEQ ID NO: 764)
Cys Cys Glu Xaa' Tyr Xaa' Cys Cys Asn Pro Ala Cys Xaa' Thr Gly Cys Xaa' Tyr        (SEQ ID NO: 765)
Cys Cys Glu Xaa' Tyr Xaa' Cys Cys Asn Pro Ala Cys Xaa' Thr Xaa' Gly Cys Tyr        (SEQ ID NO: 766)
Cys Cys Glu Xaa' Tyr Xaa' Cys Cys Asn Pro Ala Cys Xaa' Thr Gly Xaa' Cys Tyr        (SEQ ID NO: 767)
Cys Cys Glu Xaa' Tyr Xaa' Cys Cys Asn Pro Ala Cys Thr Xaa' Gly Cys Xaa' Tyr        (SEQ ID NO: 768)
Cys Cys Glu Xaa' Tyr Xaa' Cys Cys Asn Pro Ala Cys Thr Gly Cys Tyr                  (SEQ ID NO: 769)
Cys Cys Glu Xaa' Tyr Xaa' Cys Cys Asn Pro Ala Cys Thr Xaa' Gly Cys Tyr             (SEQ ID NO: 770)
Cys Cys Glu Xaa' Tyr Xaa' Cys Cys Asn Pro Ala Cys Thr Xaa' Gly Xaa' Cys Tyr        (SEQ ID NO: 771)
Cys Cys Glu Xaa' Tyr Xaa' Cys Cys Asn Pro Ala Cys Thr Gly Cys Xaa' Tyr             (SEQ ID NO: 772)
Cys Cys Glu Xaa' Tyr Xaa' Cys Cys Asn Pro Ala Cys Thr Gly Xaa' Cys Tyr             (SEQ ID NO: 773)
Cys Cys Glu Xaa' Tyr Xaa' Cys Cys Asn Pro Ala Cys Thr Gly Xaa' Cys Xaa' Tyr        (SEQ ID NO: 774)
Cys Cys Glu Xaa' Tyr Xaa' Cys Cys Asn Pro Ala Cys Thr Gly Xaa' Cys Xaa' Tyr        (SEQ ID NO: 775)
Cys Cys Glu Xaa' Tyr Xaa' Cys Cys Asn Pro Ala Cys Thr Gly Cys Xaa' Tyr             (SEQ ID NO: 776)
Cys Cys Glu Xaa' Tyr Xaa' Cys Cys Asn Pro Ala Cys Thr Gly Cys Tyr                  (SEQ ID NO: 777)
Cys Cys Glu Xaa' Tyr Cys Xaa' Asn Pro Ala Cys Thr Gly Cys Tyr                      (SEQ ID NO: 778)
Cys Cys Glu Xaa' Tyr Cys Xaa' Asn Pro Ala Cys Thr Gly Cys Tyr                      (SEQ ID NO: 779)
Cys Cys Glu Xaa' Tyr Cys Xaa' Xaa' Asn Pro Ala Cys Thr Gly Cys Tyr                 (SEQ ID NO: 780)
Cys Cys Glu Xaa' Tyr Cys Xaa' Xaa' Asn Xaa' Pro Ala Cys Thr Gly Cys Tyr            (SEQ ID NO: 781)
Cys Cys Glu Xaa' Tyr Cys Xaa' Xaa' Asn Pro Ala Cys Thr Gly Cys Tyr                 (SEQ ID NO: 782)
Cys Cys Glu Xaa' Tyr Cys Xaa' Xaa' Asn Pro Ala Xaa' Cys Thr Gly Cys Tyr            (SEQ ID NO: 783)
Cys Cys Glu Xaa' Tyr Cys Xaa' Xaa' Asn Pro Ala Cys Xaa' Thr Gly Cys Tyr            (SEQ ID NO: 784)
Cys Cys Glu Xaa' Tyr Cys Xaa' Xaa' Asn Pro Ala Cys Thr Xaa' Gly Cys Tyr            (SEQ ID NO: 785)
Cys Cys Glu Xaa' Tyr Cys Xaa' Xaa' Asn Pro Ala Cys Thr Gly Xaa' Cys Tyr            (SEQ ID NO: 786)
Cys Cys Glu Xaa' Tyr Cys Xaa' Xaa' Asn Pro Ala Cys Thr Gly Cys Xaa' Tyr            (SEQ ID NO: 787)
```

FIG. 12-16

Cys Cys Glu Xaa' Tyr Cys Cys Xaa' Asn Xaa' Pro Ala Cys Thr Gly Cys Tyr (SEQ ID NO: 788)
Cys Cys Glu Xaa' Tyr Cys Cys Xaa' Asn Xaa' Xaa' Pro Ala Cys Thr Gly Cys Tyr (SEQ ID NO: 789)
Cys Cys Glu Xaa' Tyr Cys Cys Xaa' Asn Xaa' Pro Xaa' Ala Cys Thr Gly Cys Tyr (SEQ ID NO: 790)
Cys Cys Glu Xaa' Tyr Cys Cys Xaa' Asn Xaa' Pro Ala Xaa' Cys Thr Gly Cys Tyr (SEQ ID NO: 791)
Cys Cys Glu Xaa' Tyr Cys Cys Xaa' Asn Xaa' Pro Ala Cys Xaa' Thr Gly Cys Tyr (SEQ ID NO: 792)
Cys Cys Glu Xaa' Tyr Cys Cys Xaa' Asn Xaa' Pro Ala Cys Thr Xaa' Gly Cys Tyr (SEQ ID NO: 793)
Cys Cys Glu Xaa' Tyr Cys Cys Xaa' Asn Xaa' Pro Ala Cys Thr Gly Xaa' Cys Tyr (SEQ ID NO: 794)
Cys Cys Glu Xaa' Tyr Cys Cys Xaa' Asn Xaa' Pro Ala Cys Thr Gly Cys Xaa' Tyr (SEQ ID NO: 795)
Cys Cys Glu Xaa' Tyr Cys Cys Xaa' Asn Pro Xaa' Ala Cys Thr Gly Cys Tyr (SEQ ID NO: 796)
Cys Cys Glu Xaa' Tyr Cys Cys Xaa' Asn Pro Xaa' Xaa' Ala Cys Thr Gly Cys Tyr (SEQ ID NO: 797)
Cys Cys Glu Xaa' Tyr Cys Cys Xaa' Asn Pro Xaa' Ala Xaa' Cys Thr Gly Cys Tyr (SEQ ID NO: 798)
Cys Cys Glu Xaa' Tyr Cys Cys Xaa' Asn Pro Xaa' Ala Cys Xaa' Thr Gly Cys Tyr (SEQ ID NO: 799)
Cys Cys Glu Xaa' Tyr Cys Cys Xaa' Asn Pro Xaa' Ala Cys Thr Xaa' Gly Cys Tyr (SEQ ID NO: 800)
Cys Cys Glu Xaa' Tyr Cys Cys Xaa' Asn Pro Xaa' Ala Cys Thr Gly Xaa' Cys Tyr (SEQ ID NO: 801)
Cys Cys Glu Xaa' Tyr Cys Cys Xaa' Asn Pro Xaa' Ala Cys Thr Gly Cys Xaa' Tyr (SEQ ID NO: 802)
Cys Cys Glu Xaa' Tyr Cys Cys Xaa' Asn Pro Ala Xaa' Cys Thr Gly Cys Tyr (SEQ ID NO: 803)
Cys Cys Glu Xaa' Tyr Cys Cys Xaa' Asn Pro Ala Xaa' Xaa' Cys Thr Gly Cys Tyr (SEQ ID NO: 804)
Cys Cys Glu Xaa' Tyr Cys Cys Xaa' Asn Pro Ala Xaa' Cys Xaa' Thr Gly Cys Tyr (SEQ ID NO: 805)
Cys Cys Glu Xaa' Tyr Cys Cys Xaa' Asn Pro Ala Xaa' Cys Thr Xaa' Gly Cys Tyr (SEQ ID NO: 806)
Cys Cys Glu Xaa' Tyr Cys Cys Xaa' Asn Pro Ala Xaa' Cys Thr Gly Xaa' Cys Tyr (SEQ ID NO: 807)
Cys Cys Glu Xaa' Tyr Cys Cys Xaa' Asn Pro Ala Xaa' Cys Thr Gly Cys Xaa' Tyr (SEQ ID NO: 808)
Cys Cys Glu Xaa' Tyr Cys Cys Xaa' Asn Pro Ala Cys Xaa' Thr Gly Cys Tyr (SEQ ID NO: 809)
Cys Cys Glu Xaa' Tyr Cys Cys Xaa' Asn Pro Ala Cys Xaa' Xaa' Thr Gly Cys Tyr (SEQ ID NO: 810)
Cys Cys Glu Xaa' Tyr Cys Cys Xaa' Asn Pro Ala Cys Xaa' Thr Xaa' Gly Cys Tyr (SEQ ID NO: 811)
Cys Cys Glu Xaa' Tyr Cys Cys Xaa' Asn Pro Ala Cys Xaa' Thr Gly Xaa' Cys Tyr (SEQ ID NO: 812)
Cys Cys Glu Xaa' Tyr Cys Cys Xaa' Asn Pro Ala Cys Xaa' Thr Gly Cys Xaa' Tyr (SEQ ID NO: 813)
Cys Cys Glu Xaa' Tyr Cys Cys Xaa' Asn Pro Ala Cys Thr Xaa' Gly Cys Tyr (SEQ ID NO: 814)
Cys Cys Glu Xaa' Tyr Cys Cys Xaa' Asn Pro Ala Cys Thr Xaa' Xaa' Gly Cys Tyr (SEQ ID NO: 815)
Cys Cys Glu Xaa' Tyr Cys Cys Xaa' Asn Pro Ala Cys Thr Xaa' Gly Xaa' Cys Tyr (SEQ ID NO: 816)

FIG. 12-17

Cys Cys Glu Xaa' Tyr Cys Cys Xaa' Asn Pro Ala Cys Thr Xaa' Gly Cys Xaa' Tyr (SEQ ID NO: 817)
Cys Cys Glu Xaa' Tyr Cys Cys Xaa' Asn Pro Ala Cys Thr Gly Xaa' Cys Tyr (SEQ ID NO: 818)
Cys Cys Glu Xaa' Tyr Cys Cys Xaa' Asn Pro Ala Cys Thr Gly Xaa' Kaa' Cys Tyr (SEQ ID NO: 819)
Cys Cys Glu Xaa' Tyr Cys Cys Xaa' Asn Pro Ala Cys Thr Gly Xaa' Cys Xaa' Tyr (SEQ ID NO: 820)
Cys Cys Glu Xaa' Tyr Cys Cys Xaa' Asn Pro Ala Cys Thr Gly Cys Xaa' Tyr (SEQ ID NO: 821)
Cys Cys Glu Xaa' Tyr Cys Cys Xaa' Asn Pro Ala Cys Thr Gly Cys Xaa' Xaa' Tyr (SEQ ID NO: 822)
Cys Cys Glu Xaa' Tyr Cys Cys Xaa' Asn Pro Ala Cys Thr Gly Cys Tyr (SEQ ID NO: 823)
Cys Cys Glu Xaa' Tyr Cys Cys Asn Xaa' Pro Ala Cys Thr Gly Cys Tyr (SEQ ID NO: 824)
Cys Cys Glu Xaa' Tyr Cys Cys Asn Xaa' Xaa' Pro Ala Cys Thr Gly Cys Tyr (SEQ ID NO: 825)
Cys Cys Glu Xaa' Tyr Cys Cys Asn Xaa' Xaa' Pro Xaa' Ala Cys Thr Gly Cys Tyr (SEQ ID NO: 826)
Cys Cys Glu Xaa' Tyr Cys Cys Asn Xaa' Xaa' Pro Ala Xaa' Cys Thr Gly Cys Tyr (SEQ ID NO: 827)
Cys Cys Glu Xaa' Tyr Cys Cys Asn Xaa' Xaa' Pro Ala Cys Xaa' Thr Gly Cys Tyr (SEQ ID NO: 828)
Cys Cys Glu Xaa' Tyr Cys Cys Asn Xaa' Xaa' Pro Ala Cys Thr Xaa' Gly Cys Tyr (SEQ ID NO: 829)
Cys Cys Glu Xaa' Tyr Cys Cys Asn Xaa' Xaa' Pro Ala Cys Thr Gly Xaa' Cys Tyr (SEQ ID NO: 830)
Cys Cys Glu Xaa' Tyr Cys Cys Asn Xaa' Xaa' Pro Ala Cys Thr Gly Cys Xaa' Tyr (SEQ ID NO: 831)
Cys Cys Glu Xaa' Tyr Cys Cys Asn Xaa' Pro Xaa' Ala Cys Thr Gly Cys Tyr (SEQ ID NO: 832)
Cys Cys Glu Xaa' Tyr Cys Cys Asn Xaa' Pro Ala Xaa' Cys Thr Gly Cys Tyr (SEQ ID NO: 833)
Cys Cys Glu Xaa' Tyr Cys Cys Asn Xaa' Pro Ala Cys Xaa' Thr Gly Cys Tyr (SEQ ID NO: 834)
Cys Cys Glu Xaa' Tyr Cys Cys Asn Xaa' Pro Ala Cys Thr Xaa' Gly Cys Tyr (SEQ ID NO: 835)
Cys Cys Glu Xaa' Tyr Cys Cys Asn Xaa' Pro Ala Cys Thr Gly Xaa' Cys Tyr (SEQ ID NO: 836)
Cys Cys Glu Xaa' Tyr Cys Cys Asn Xaa' Pro Ala Cys Thr Gly Cys Xaa' Tyr (SEQ ID NO: 837)
Cys Cys Glu Xaa' Tyr Cys Cys Asn Xaa' Pro Ala Cys Thr Gly Cys Tyr (SEQ ID NO: 838)
Cys Cys Glu Xaa' Tyr Cys Cys Asn Xaa' Pro Ala Cys Thr Gly Cys Tyr (SEQ ID NO: 839)
Cys Cys Glu Xaa' Tyr Cys Cys Asn Xaa' Pro Ala Cys Xaa' Thr Gly Cys Tyr (SEQ ID NO: 840)
Cys Cys Glu Xaa' Tyr Cys Cys Asn Xaa' Pro Ala Cys Thr Xaa' Gly Cys Tyr (SEQ ID NO: 841)
Cys Cys Glu Xaa' Tyr Cys Cys Asn Xaa' Pro Ala Cys Thr Gly Xaa' Cys Tyr (SEQ ID NO: 842)
Cys Cys Glu Xaa' Tyr Cys Cys Asn Xaa' Pro Ala Cys Thr Gly Cys Xaa' Tyr (SEQ ID NO: 843)
Cys Cys Glu Xaa' Tyr Cys Cys Asn Xaa' Pro Ala Cys Thr Gly Cys Xaa' Tyr (SEQ ID NO: 844)
Cys Cys Glu Xaa' Tyr Cys Cys Asn Xaa' Pro Ala Cys Xaa' Thr Gly Cys Tyr (SEQ ID NO: 845)

| | | | | | | | | | | | | | | | | | | |
|---|---|---|---|---|---|---|---|---|---|---|---|---|---|---|---|---|---|---|
| Cys | Cys | Glu | Xaa' | Tyr | Cys | Cys | Asn | Xaa | Pro | Ala | Cys | Xaa' | Xaa' | Thr | Gly | Cys | Tyr | (SEQ ID NO: 846) |
| Cys | Cys | Glu | Xaa' | Tyr | Cys | Cys | Asn | Xaa | Pro | Ala | Cys | Xaa' | Thr | Gly | Cys | Tyr | | (SEQ ID NO: 847) |
| Cys | Cys | Glu | Xaa' | Tyr | Cys | Cys | Asn | Xaa | Pro | Ala | Cys | Xaa' | Thr | Gly | Xaa' | Cys | Tyr | (SEQ ID NO: 848) |
| Cys | Cys | Glu | Xaa' | Tyr | Cys | Cys | Asn | Xaa | Pro | Ala | Cys | Xaa' | Thr | Gly | Cys | Xaa' | Tyr | (SEQ ID NO: 849) |
| Cys | Cys | Glu | Xaa' | Tyr | Cys | Cys | Asn | Xaa | Pro | Ala | Cys | Thr | Gly | Cys | Tyr | | | (SEQ ID NO: 850) |
| Cys | Cys | Glu | Xaa' | Tyr | Cys | Cys | Asn | Xaa | Pro | Ala | Cys | Thr | Xaa' | Gly | Cys | Tyr | | (SEQ ID NO: 851) |
| Cys | Cys | Glu | Xaa' | Tyr | Cys | Cys | Asn | Xaa | Pro | Ala | Cys | Thr | Gly | Xaa' | Cys | Tyr | | (SEQ ID NO: 852) |
| Cys | Cys | Glu | Xaa' | Tyr | Cys | Cys | Asn | Xaa | Pro | Ala | Cys | Thr | Gly | Cys | Xaa' | Tyr | | (SEQ ID NO: 853) |
| Cys | Cys | Glu | Xaa' | Tyr | Cys | Cys | Asn | Xaa | Pro | Ala | Cys | Xaa' | Cys | Tyr | | | | (SEQ ID NO: 854) |
| Cys | Cys | Glu | Xaa' | Tyr | Cys | Cys | Asn | Xaa | Pro | Ala | Cys | Xaa' | Xaa' | Cys | Tyr | | | (SEQ ID NO: 855) |
| Cys | Cys | Glu | Xaa' | Tyr | Cys | Cys | Asn | Xaa | Pro | Ala | Cys | Xaa' | Cys | Xaa' | Tyr | | | (SEQ ID NO: 856) |
| Cys | Cys | Glu | Xaa' | Tyr | Cys | Cys | Asn | Xaa | Pro | Ala | Cys | Thr | Gly | Cys | Xaa' | Tyr | | (SEQ ID NO: 857) |
| Cys | Cys | Glu | Xaa' | Tyr | Cys | Cys | Asn | Pro | Ala | Cys | Thr | Gly | Cys | Tyr | | | | (SEQ ID NO: 858) |
| Cys | Cys | Glu | Xaa' | Tyr | Cys | Cys | Asn | Pro | Xaa' | Ala | Cys | Thr | Gly | Cys | Tyr | | | (SEQ ID NO: 859) |
| Cys | Cys | Glu | Xaa' | Tyr | Cys | Cys | Asn | Pro | Xaa' | Ala | Xaa' | Cys | Thr | Gly | Cys | Tyr | | (SEQ ID NO: 860) |
| Cys | Cys | Glu | Xaa' | Tyr | Cys | Cys | Asn | Pro | Xaa' | Ala | Xaa' | Cys | Xaa' | Thr | Gly | Cys | Tyr | (SEQ ID NO: 861) |
| Cys | Cys | Glu | Xaa' | Tyr | Cys | Cys | Asn | Pro | Xaa' | Ala | Xaa' | Cys | Thr | Xaa' | Gly | Cys | Tyr | (SEQ ID NO: 862) |
| Cys | Cys | Glu | Xaa' | Tyr | Cys | Cys | Asn | Pro | Xaa' | Ala | Xaa' | Cys | Thr | Gly | Xaa' | Cys | Tyr | (SEQ ID NO: 863) |
| Cys | Cys | Glu | Xaa' | Tyr | Cys | Cys | Asn | Pro | Xaa' | Ala | Xaa' | Cys | Thr | Gly | Cys | Xaa' | Tyr | (SEQ ID NO: 864) |
| Cys | Cys | Glu | Xaa' | Tyr | Cys | Cys | Asn | Pro | Xaa' | Ala | Xaa' | Cys | Thr | Gly | Cys | Tyr | | (SEQ ID NO: 865) |
| Cys | Cys | Glu | Xaa' | Tyr | Cys | Cys | Asn | Pro | Xaa' | Ala | Xaa' | Cys | Thr | Gly | Xaa' | Cys | Tyr | (SEQ ID NO: 866) |
| Cys | Cys | Glu | Xaa' | Tyr | Cys | Cys | Asn | Pro | Xaa' | Ala | Xaa' | Cys | Thr | Gly | Cys | Xaa' | Tyr | (SEQ ID NO: 867) |
| Cys | Cys | Glu | Xaa' | Tyr | Cys | Cys | Asn | Pro | Xaa' | Ala | Xaa' | Cys | Thr | Gly | Cys | Tyr | | (SEQ ID NO: 868) |
| Cys | Cys | Glu | Xaa' | Tyr | Cys | Cys | Asn | Pro | Xaa' | Ala | Xaa' | Cys | Xaa' | Thr | Gly | Cys | Tyr | (SEQ ID NO: 869) |
| Cys | Cys | Glu | Xaa' | Tyr | Cys | Cys | Asn | Pro | Xaa' | Ala | Xaa' | Cys | Thr | Gly | Xaa' | Cys | Tyr | (SEQ ID NO: 870) |
| Cys | Cys | Glu | Xaa' | Tyr | Cys | Cys | Asn | Pro | Xaa' | Ala | Xaa' | Cys | Thr | Gly | Cys | Xaa' | Tyr | (SEQ ID NO: 871) |
| Cys | Cys | Glu | Xaa' | Tyr | Cys | Cys | Asn | Pro | Xaa' | Ala | Xaa' | Cys | Thr | Gly | Cys | Tyr | | (SEQ ID NO: 872) |
| Cys | Cys | Glu | Xaa' | Tyr | Cys | Cys | Asn | Pro | Xaa' | Ala | Xaa' | Cys | Xaa' | Cys | Tyr | | | (SEQ ID NO: 873) |
| Cys | Cys | Glu | Xaa' | Tyr | Cys | Cys | Asn | Pro | Xaa' | Ala | Cys | Xaa' | Thr | Gly | Cys | Tyr | | (SEQ ID NO: 874) |

Cys Cys Glu Xaa' Tyr Cys Cys Asn Pro Xaa' Ala Cys Xaa' Thr Xaa' Gly Cys Tyr (SEQ ID NO: 875)
Cys Cys Glu Xaa' Tyr Cys Cys Asn Pro Xaa' Ala Cys Xaa' Thr Gly Xaa' Cys Tyr (SEQ ID NO: 876)
Cys Cys Glu Xaa' Tyr Cys Cys Asn Pro Xaa' Ala Cys Xaa' Thr Gly Cys Xaa' Tyr (SEQ ID NO: 877)
Cys Cys Glu Xaa' Tyr Cys Cys Asn Pro Xaa' Ala Cys Thr Xaa' Gly Cys Tyr (SEQ ID NO: 878)
Cys Cys Glu Xaa' Tyr Cys Cys Asn Pro Xaa' Ala Cys Thr Xaa' Xaa' Gly Cys Tyr (SEQ ID NO: 879)
Cys Cys Glu Xaa' Tyr Cys Cys Asn Pro Xaa' Ala Cys Thr Xaa' Gly Xaa' Cys Tyr (SEQ ID NO: 880)
Cys Cys Glu Xaa' Tyr Cys Cys Asn Pro Xaa' Ala Cys Thr Xaa' Gly Cys Xaa' Tyr (SEQ ID NO: 881)
Cys Cys Glu Xaa' Tyr Cys Cys Asn Pro Xaa' Ala Cys Thr Gly Xaa' Cys Tyr (SEQ ID NO: 882)
Cys Cys Glu Xaa' Tyr Cys Cys Asn Pro Xaa' Ala Cys Thr Gly Xaa' Xaa' Cys Tyr (SEQ ID NO: 883)
Cys Cys Glu Xaa' Tyr Cys Cys Asn Pro Xaa' Ala Cys Thr Gly Xaa' Cys Xaa' Tyr (SEQ ID NO: 884)
Cys Cys Glu Xaa' Tyr Cys Cys Asn Pro Xaa' Ala Cys Thr Gly Cys Xaa' Tyr (SEQ ID NO: 885)
Cys Cys Glu Xaa' Tyr Cys Cys Asn Pro Xaa' Ala Cys Thr Gly Cys Xaa' Xaa' Tyr (SEQ ID NO: 886)
Cys Cys Glu Xaa' Tyr Cys Cys Asn Pro Ala Xaa' Cys Thr Gly Cys Tyr (SEQ ID NO: 887)
Cys Cys Glu Xaa' Tyr Cys Cys Asn Pro Ala Xaa' Xaa' Cys Thr Gly Cys Tyr (SEQ ID NO: 888)
Cys Cys Glu Xaa' Tyr Cys Cys Asn Pro Ala Xaa' Cys Xaa' Thr Gly Cys Tyr (SEQ ID NO: 889)
Cys Cys Glu Xaa' Tyr Cys Cys Asn Pro Ala Xaa' Cys Thr Xaa' Gly Cys Tyr (SEQ ID NO: 890)
Cys Cys Glu Xaa' Tyr Cys Cys Asn Pro Ala Xaa' Cys Thr Gly Xaa' Cys Tyr (SEQ ID NO: 891)
Cys Cys Glu Xaa' Tyr Cys Cys Asn Pro Ala Xaa' Cys Thr Gly Cys Xaa' Tyr (SEQ ID NO: 892)
Cys Cys Glu Xaa' Tyr Cys Cys Asn Pro Ala Xaa' Cys Thr Xaa' Gly Cys Xaa' Tyr (SEQ ID NO: 893)
Cys Cys Glu Xaa' Tyr Cys Cys Asn Pro Ala Xaa' Cys Xaa' Thr Gly Cys Xaa' Tyr (SEQ ID NO: 894)
Cys Cys Glu Xaa' Tyr Cys Cys Asn Pro Ala Xaa' Xaa' Cys Thr Gly Cys Tyr (SEQ ID NO: 895)
Cys Cys Glu Xaa' Tyr Cys Cys Asn Pro Ala Xaa' Cys Xaa' Xaa' Gly Cys Tyr (SEQ ID NO: 896)
Cys Cys Glu Xaa' Tyr Cys Cys Asn Pro Ala Xaa' Cys Xaa' Gly Xaa' Cys Tyr (SEQ ID NO: 897)
Cys Cys Glu Xaa' Tyr Cys Cys Asn Pro Ala Xaa' Cys Xaa' Gly Cys Xaa' Tyr (SEQ ID NO: 898)
Cys Cys Glu Xaa' Tyr Cys Cys Asn Pro Ala Xaa' Cys Thr Xaa' Gly Cys Tyr (SEQ ID NO: 899)
Cys Cys Glu Xaa' Tyr Cys Cys Asn Pro Ala Xaa' Cys Thr Xaa' Xaa' Gly Cys Tyr (SEQ ID NO: 900)
Cys Cys Glu Xaa' Tyr Cys Cys Asn Pro Ala Xaa' Cys Thr Xaa' Gly Xaa' Cys Tyr (SEQ ID NO: 901)
Cys Cys Glu Xaa' Tyr Cys Cys Asn Pro Ala Xaa' Cys Thr Gly Xaa' Cys Tyr (SEQ ID NO: 902)
Cys Cys Glu Xaa' Tyr Cys Cys Asn Pro Ala Xaa' Cys Thr Gly Xaa' Cys Tyr (SEQ ID NO: 903)

| | | | | | | | | | | |
|---|---|---|---|---|---|---|---|---|---|---|
| Cys | Cys Glu Xaa' | Tyr | Cys | Cys Asn Pro Ala Xaa' | Cys Thr Gly Xaa' Xaa' Cys Tyr | (SEQ ID NO: 904) |
| Cys | Cys Glu Xaa' | Tyr | Cys | Cys Asn Pro Ala Xaa' | Cys Thr Gly Xaa' Cys Xaa' Tyr | (SEQ ID NO: 905) |
| Cys | Cys Glu Xaa' | Tyr | Cys | Cys Asn Pro Ala Xaa' | Cys Thr Gly Cys Xaa' Xaa' Tyr | (SEQ ID NO: 906) |
| Cys | Cys Glu Xaa' | Tyr | Cys | Cys Asn Pro Ala Xaa' | Cys Thr Gly Cys Xaa' Xaa' Tyr | (SEQ ID NO: 907) |
| Cys | Cys Glu Xaa' | Tyr | Cys | Cys Asn Pro Ala Cys | Xaa' Thr Gly Cys Tyr | (SEQ ID NO: 908) |
| Cys | Cys Glu Xaa' | Tyr | Cys | Cys Asn Pro Ala Cys | Xaa' Xaa' Thr Gly Cys Tyr | (SEQ ID NO: 909) |
| Cys | Cys Glu Xaa' | Tyr | Cys | Cys Asn Pro Ala Cys | Xaa' Xaa' Thr Gly Cys Tyr | (SEQ ID NO: 910) |
| Cys | Cys Glu Xaa' | Tyr | Cys | Cys Asn Pro Ala Cys | Xaa' Xaa' Thr Xaa' Gly Cys Tyr | (SEQ ID NO: 911) |
| Cys | Cys Glu Xaa' | Tyr | Cys | Cys Asn Pro Ala Cys | Xaa' Xaa' Thr Gly Xaa' Cys Tyr | (SEQ ID NO: 912) |
| Cys | Cys Glu Xaa' | Tyr | Cys | Cys Asn Pro Ala Cys | Xaa' Xaa' Thr Gly Cys Xaa' Tyr | (SEQ ID NO: 913) |
| Cys | Cys Glu Xaa' | Tyr | Cys | Cys Asn Pro Ala Cys | Xaa' Thr Xaa' Gly Cys Tyr | (SEQ ID NO: 914) |
| Cys | Cys Glu Xaa' | Tyr | Cys | Cys Asn Pro Ala Cys | Xaa' Thr Xaa' Gly Cys Tyr | (SEQ ID NO: 915) |
| Cys | Cys Glu Xaa' | Tyr | Cys | Cys Asn Pro Ala Cys | Xaa' Thr Xaa' Gly Xaa' Cys Tyr | (SEQ ID NO: 916) |
| Cys | Cys Glu Xaa' | Tyr | Cys | Cys Asn Pro Ala Cys | Xaa' Thr Xaa' Gly Cys Xaa' Tyr | (SEQ ID NO: 917) |
| Cys | Cys Glu Xaa' | Tyr | Cys | Cys Asn Pro Ala Cys | Xaa' Thr Gly Xaa' Cys Tyr | (SEQ ID NO: 918) |
| Cys | Cys Glu Xaa' | Tyr | Cys | Cys Asn Pro Ala Cys | Xaa' Thr Gly Xaa' Xaa' Cys Tyr | (SEQ ID NO: 919) |
| Cys | Cys Glu Xaa' | Tyr | Cys | Cys Asn Pro Ala Cys | Xaa' Thr Gly Xaa' Cys Xaa' Tyr | (SEQ ID NO: 920) |
| Cys | Cys Glu Xaa' | Tyr | Cys | Cys Asn Pro Ala Cys | Xaa' Thr Gly Cys Xaa' Tyr | (SEQ ID NO: 921) |
| Cys | Cys Glu Xaa' | Tyr | Cys | Cys Asn Pro Ala Cys | Xaa' Thr Gly Cys Xaa' Tyr | (SEQ ID NO: 922) |
| Cys | Cys Glu Xaa' | Tyr | Cys | Cys Asn Pro Ala Cys | Thr Xaa' Xaa' Gly Cys Tyr | (SEQ ID NO: 923) |
| Cys | Cys Glu Xaa' | Tyr | Cys | Cys Asn Pro Ala Cys | Thr Xaa' Xaa' Gly Xaa' Cys Tyr | (SEQ ID NO: 924) |
| Cys | Cys Glu Xaa' | Tyr | Cys | Cys Asn Pro Ala Cys | Thr Xaa' Xaa' Gly Cys Xaa' Tyr | (SEQ ID NO: 925) |
| Cys | Cys Glu Xaa' | Tyr | Cys | Cys Asn Pro Ala Cys | Thr Xaa' Gly Xaa' Cys Tyr | (SEQ ID NO: 926) |
| Cys | Cys Glu Xaa' | Tyr | Cys | Cys Asn Pro Ala Cys | Thr Xaa' Gly Xaa' Xaa' Cys Tyr | (SEQ ID NO: 927) |
| Cys | Cys Glu Xaa' | Tyr | Cys | Cys Asn Pro Ala Cys | Thr Xaa' Gly Xaa' Cys Xaa' Tyr | (SEQ ID NO: 928) |
| Cys | Cys Glu Xaa' | Tyr | Cys | Cys Asn Pro Ala Cys | Thr Xaa' Gly Cys Xaa' Tyr | (SEQ ID NO: 929) |
| Cys | Cys Glu Xaa' | Tyr | Cys | Cys Asn Pro Ala Cys | Thr Xaa' Gly Xaa' Cys Xaa' Tyr | (SEQ ID NO: 930) |
| Cys | Cys Glu Xaa' | Tyr | Cys | Cys Asn Pro Ala Cys | Thr Gly Cys Xaa' Tyr | (SEQ ID NO: 931) |
| Cys | Cys Glu Xaa' | Tyr | Cys | Cys Asn Pro Ala Cys | Thr Xaa' Gly Cys Xaa' Xaa' Tyr | (SEQ ID NO: 932) |

Cys Cys Glu Xaa' Tyr Cys Cys Asn Pro Ala Cys Thr Gly Xaa' Cys Tyr (SEQ ID NO: 933)
Cys Cys Glu Xaa' Tyr Cys Cys Asn Pro Ala Cys Thr Gly Xaa' Cys Tyr (SEQ ID NO: 934)
Cys Cys Glu Xaa' Tyr Cys Cys Asn Pro Ala Cys Thr Gly Xaa' Cys Tyr (SEQ ID NO: 935)
Cys Cys Glu Xaa' Tyr Cys Cys Asn Pro Ala Cys Thr Gly Xaa' Cys Tyr (SEQ ID NO: 936)
Cys Cys Glu Xaa' Tyr Cys Cys Asn Pro Ala Cys Thr Gly Xaa' Cys Tyr (SEQ ID NO: 937)
Cys Cys Glu Xaa' Tyr Cys Cys Asn Pro Ala Cys Thr Gly Xaa' Cys Tyr (SEQ ID NO: 938)
Cys Cys Glu Xaa' Tyr Cys Cys Asn Pro Ala Cys Thr Gly Xaa' Cys Tyr (SEQ ID NO: 939)
Cys Cys Glu Xaa' Tyr Cys Cys Asn Pro Ala Cys Thr Gly Xaa' Cys Tyr (SEQ ID NO: 940)
Cys Cys Glu Xaa' Tyr Cys Cys Asn Pro Ala Cys Thr Gly Xaa' Cys Tyr (SEQ ID NO: 941)
Cys Cys Glu Tyr Xaa' Cys Cys Asn Pro Ala Cys Thr Gly Xaa' Cys Tyr (SEQ ID NO: 942)
Cys Cys Glu Tyr Xaa' Cys Cys Asn Pro Ala Cys Thr Gly Xaa' Cys Tyr (SEQ ID NO: 943)
Cys Cys Glu Tyr Xaa' Cys Cys Asn Pro Ala Cys Thr Gly Cys Tyr (SEQ ID NO: 944)
Cys Cys Glu Tyr Xaa' Cys Cys Asn Pro Ala Cys Thr Gly Cys Tyr (SEQ ID NO: 945)
Cys Cys Glu Tyr Xaa' Cys Cys Asn Pro Ala Cys Thr Gly Cys Tyr (SEQ ID NO: 946)
Cys Cys Glu Tyr Xaa' Cys Cys Xaa' Asn Pro Ala Cys Thr Gly Cys Tyr (SEQ ID NO: 947)
Cys Cys Glu Tyr Xaa' Cys Cys Xaa' Asn Pro Ala Cys Thr Gly Cys Tyr (SEQ ID NO: 948)
Cys Cys Glu Tyr Xaa' Cys Cys Asn Pro Ala Xaa' Cys Thr Gly Cys Tyr (SEQ ID NO: 949)
Cys Cys Glu Tyr Xaa' Cys Cys Asn Pro Ala Cys Thr' Gly Cys Tyr (SEQ ID NO: 950)
Cys Cys Glu Tyr Xaa' Cys Cys Asn Pro Ala Cys Thr Xaa' Gly Cys Tyr (SEQ ID NO: 951)
Cys Cys Glu Tyr Xaa' Cys Cys Asn Pro Ala Cys Thr Gly Xaa' Cys Tyr (SEQ ID NO: 852)
Cys Cys Glu Tyr Xaa' Cys Cys Asn Pro Ala Cys Thr Gly Cys Xaa' Tyr (SEQ ID NO: 953)
Cys Cys Glu Tyr Xaa' Cys Cys Xaa' Asn Pro Ala Cys Thr Gly Cys Tyr (SEQ ID NO: 954)
Cys Cys Glu Tyr Xaa' Cys Cys Xaa' Asn Pro Ala Cys Thr Gly Cys Tyr (SEQ ID NO: 955)
Cys Cys Glu Tyr Xaa' Cys Cys Xaa' Asn Pro Ala Cys Thr Gly Cys Tyr (SEQ ID NO: 956)
Cys Cys Glu Tyr Xaa' Cys Cys Xaa' Asn Pro Ala Cys Thr Gly Cys Tyr (SEQ ID NO: 957)
Cys Cys Glu Tyr Xaa' Cys Cys Xaa' Asn Pro Ala Cys Thr Gly Cys Tyr (SEQ ID NO: 958)
Cys Cys Glu Tyr Xaa' Cys Cys Xaa' Asn Pro Ala Cys Thr Gly Cys Tyr (SEQ ID NO: 959)
Cys Cys Glu Tyr Xaa' Cys Cys Xaa' Asn Pro Ala Cys Thr Xaa' Gly Cys Tyr (SEQ ID NO: 960)
Cys Cys Glu Tyr Xaa' Cys Cys Xaa' Asn Pro Ala Cys Thr Gly Xaa' Cys Tyr (SEQ ID NO: 961)

| | | | | | | | | | | |
|---|---|---|---|---|---|---|---|---|---|---|
| Cys | Cys | Glu | Tyr | Xaa' | Xaa' | Cys | Cys | Xaa' | Asn | Pro | Ala | Cys | Thr | Gly | Cys | Xaa' | Tyr | (SEQ ID NO: 962) |

(Table format too complex — rendering as sequence list)

Cys Cys Glu Tyr Xaa' Xaa' Cys Cys Xaa' Asn Pro Ala Cys Thr Gly Cys Xaa' Tyr (SEQ ID NO: 962)
Cys Cys Glu Tyr Xaa' Xaa' Cys Cys Asn Xaa' Pro Ala Cys Thr Gly Cys Tyr (SEQ ID NO: 963)
Cys Cys Glu Tyr Xaa' Xaa' Cys Cys Asn Xaa' Xaa' Pro Ala Cys Thr Gly Cys Tyr (SEQ ID NO: 964)
Cys Cys Glu Tyr Xaa' Xaa' Cys Cys Asn Xaa' Pro Ala Cys Thr Gly Cys Tyr (SEQ ID NO: 965)
Cys Cys Glu Tyr Xaa' Xaa' Cys Cys Asn Xaa' Pro Ala Cys Thr Gly Cys Tyr (SEQ ID NO: 966)
Cys Cys Glu Tyr Xaa' Xaa' Cys Cys Asn Xaa' Pro Ala Cys Xaa' Thr Gly Cys Tyr (SEQ ID NO: 967)
Cys Cys Glu Tyr Xaa' Xaa' Cys Cys Asn Xaa' Pro Ala Cys Thr Xaa' Gly Cys Tyr (SEQ ID NO: 968)
Cys Cys Glu Tyr Xaa' Xaa' Cys Cys Asn Xaa' Pro Ala Cys Thr Gly Xaa' Cys Tyr (SEQ ID NO: 969)
Cys Cys Glu Tyr Xaa' Xaa' Cys Cys Asn Xaa' Pro Ala Cys Thr Gly Cys Xaa' Tyr (SEQ ID NO: 970)
Cys Cys Glu Tyr Xaa' Xaa' Cys Cys Asn Pro Xaa' Ala Cys Thr Gly Cys Tyr (SEQ ID NO: 971)
Cys Cys Glu Tyr Xaa' Xaa' Cys Cys Asn Pro Xaa' Ala Cys Thr Gly Cys Tyr (SEQ ID NO: 972)
Cys Cys Glu Tyr Xaa' Xaa' Cys Cys Asn Pro Xaa' Ala Xaa' Cys Thr Gly Cys Tyr (SEQ ID NO: 973)
Cys Cys Glu Tyr Xaa' Xaa' Cys Cys Asn Pro Ala Xaa' Cys Thr Gly Cys Tyr (SEQ ID NO: 974)
Cys Cys Glu Tyr Xaa' Xaa' Cys Cys Asn Pro Ala Xaa' Cys Thr Gly Cys Tyr (SEQ ID NO: 975)
Cys Cys Glu Tyr Xaa' Xaa' Cys Cys Asn Pro Ala Cys Xaa' Thr Gly Cys Tyr (SEQ ID NO: 976)
Cys Cys Glu Tyr Xaa' Xaa' Cys Cys Asn Pro Ala Xaa' Cys Thr Gly Cys Xaa' Tyr (SEQ ID NO: 977)
Cys Cys Glu Tyr Xaa' Xaa' Cys Cys Asn Pro Ala Xaa' Cys Thr Gly Cys Tyr (SEQ ID NO: 978)
Cys Cys Glu Tyr Xaa' Xaa' Cys Cys Asn Pro Ala Xaa' Cys Thr Gly Cys Tyr (SEQ ID NO: 979)
Cys Cys Glu Tyr Xaa' Xaa' Cys Cys Asn Pro Ala Xaa' Thr Gly Cys Tyr (SEQ ID NO: 980)
Cys Cys Glu Tyr Xaa' Xaa' Cys Cys Asn Pro Ala Cys Thr Xaa' Gly Cys Tyr (SEQ ID NO: 981)
Cys Cys Glu Tyr Xaa' Xaa' Cys Cys Asn Pro Ala Cys Thr Xaa' Gly Cys Tyr (SEQ ID NO: 982)
Cys Cys Glu Tyr Xaa' Xaa' Cys Cys Asn Pro Ala Cys Thr Xaa' Gly Cys Xaa' Tyr (SEQ ID NO: 983)
Cys Cys Glu Tyr Xaa' Xaa' Cys Cys Asn Pro Ala Cys Xaa' Thr Gly Cys Tyr (SEQ ID NO: 984)
Cys Cys Glu Tyr Xaa' Xaa' Cys Cys Asn Pro Ala Cys Xaa' Thr Gly Cys Tyr (SEQ ID NO: 985)
Cys Cys Glu Tyr Xaa' Xaa' Cys Cys Asn Pro Ala Cys Xaa' Thr Gly Cys Tyr (SEQ ID NO: 986)
Cys Cys Glu Tyr Xaa' Xaa' Cys Cys Asn Pro Ala Cys Xaa' Thr Gly Cys Xaa' Tyr (SEQ ID NO: 987)
Cys Cys Glu Tyr Xaa' Xaa' Cys Cys Asn Pro Ala Cys Thr Xaa' Gly Cys Tyr (SEQ ID NO: 988)
Cys Cys Glu Tyr Xaa' Xaa' Cys Cys Asn Pro Ala Cys Thr Xaa' Gly Cys Tyr (SEQ ID NO: 989)
Cys Cys Glu Tyr Xaa' Xaa' Cys Cys Asn Pro Ala Cys Thr Xaa' Gly Cys Tyr (SEQ ID NO: 990)

```
Cys Cys Glu Tyr Xaa' Xaa' Cys Cys Asn Pro Ala Cys Thr Xaa' Gly Xaa' Cys Tyr   (SEQ ID NO: 991)
Cys Cys Glu Tyr Xaa' Xaa' Cys Cys Asn Pro Ala Cys Thr Xaa' Gly Xaa' Cys Xaa' Tyr   (SEQ ID NO: 992)
Cys Cys Glu Tyr Xaa' Xaa' Cys Cys Asn Pro Ala Cys Thr Xaa' Gly Xaa' Cys Tyr   (SEQ ID NO: 993)
Cys Cys Glu Tyr Xaa' Xaa' Cys Cys Asn Pro Ala Cys Thr Gly Xaa' Cys Tyr   (SEQ ID NO: 994)
Cys Cys Glu Tyr Xaa' Xaa' Cys Cys Asn Pro Ala Cys Thr Gly Xaa' Xaa' Cys Tyr   (SEQ ID NO: 995)
Cys Cys Glu Tyr Xaa' Xaa' Cys Cys Asn Pro Ala Cys Thr Gly Cys Xaa' Tyr   (SEQ ID NO: 996)
Cys Cys Glu Tyr Xaa' Xaa' Cys Cys Asn Pro Ala Cys Thr Gly Cys Xaa' Xaa' Tyr   (SEQ ID NO: 997)
Cys Cys Glu Tyr Xaa' Xaa' Cys Xaa' Asn Pro Ala Cys Thr Gly Cys Tyr   (SEQ ID NO: 998)
Cys Cys Glu Tyr Xaa' Xaa' Cys Xaa' Xaa' Asn Pro Ala Cys Thr Gly Cys Tyr   (SEQ ID NO: 999)
Cys Cys Glu Tyr Xaa' Xaa' Cys Xaa' Xaa' Asn Pro Ala Cys Thr Gly Cys Tyr   (SEQ ID NO: 1000)
Cys Cys Glu Tyr Xaa' Xaa' Cys Xaa' Asn Xaa' Pro Ala Cys Thr Gly Cys Tyr   (SEQ ID NO: 1001)
Cys Cys Glu Tyr Xaa' Xaa' Cys Xaa' Asn Xaa' Pro Ala Cys Thr Gly Cys Xaa' Tyr   (SEQ ID NO: 1002)
Cys Cys Glu Tyr Xaa' Xaa' Cys Xaa' Asn Pro Xaa' Ala Cys Thr Gly Cys Tyr   (SEQ ID NO: 1003)
Cys Cys Glu Tyr Xaa' Xaa' Cys Xaa' Asn Pro Xaa' Ala Cys Xaa' Thr Gly Cys Tyr   (SEQ ID NO: 1004)
Cys Cys Glu Tyr Xaa' Xaa' Cys Xaa' Asn Pro Ala Cys Xaa' Thr Gly Cys Tyr   (SEQ ID NO: 1005)
Cys Cys Glu Tyr Xaa' Xaa' Cys Xaa' Asn Pro Ala Cys Xaa' Thr Gly Xaa' Cys Tyr   (SEQ ID NO: 1006)
Cys Cys Glu Tyr Xaa' Xaa' Cys Xaa' Asn Pro Ala Cys Thr Gly Cys Tyr   (SEQ ID NO: 1007)
Cys Cys Glu Tyr Xaa' Xaa' Cys Cys Asn Xaa' Pro Ala Cys Thr Gly Cys Tyr   (SEQ ID NO: 1008)
Cys Cys Glu Tyr Xaa' Xaa' Cys Xaa' Asn Xaa' Pro Xaa' Ala Cys Thr Gly Cys Tyr   (SEQ ID NO: 1009)
Cys Cys Glu Tyr Xaa' Xaa' Cys Xaa' Asn Xaa' Pro Xaa' Ala Cys Thr Gly Cys Tyr   (SEQ ID NO: 1010)
Cys Cys Glu Tyr Xaa' Xaa' Cys Xaa' Asn Xaa' Pro Ala Cys Xaa' Thr Gly Cys Tyr   (SEQ ID NO: 1011)
Cys Cys Glu Tyr Xaa' Xaa' Cys Xaa' Asn Xaa' Pro Ala Cys Xaa' Thr Gly Cys Xaa' Tyr   (SEQ ID NO: 1012)
Cys Cys Glu Tyr Xaa' Xaa' Cys Xaa' Asn Pro Ala Cys Xaa' Thr Gly Xaa' Cys Tyr   (SEQ ID NO: 1013)
Cys Cys Glu Tyr Xaa' Xaa' Cys Xaa' Asn Pro Xaa' Ala Cys Xaa' Thr Gly Xaa' Cys Tyr   (SEQ ID NO: 1014)
Cys Cys Glu Tyr Xaa' Xaa' Cys Xaa' Asn Pro Xaa' Ala Cys Xaa' Thr Gly Cys Xaa' Tyr   (SEQ ID NO: 1015)
Cys Cys Glu Tyr Xaa' Xaa' Cys Xaa' Asn Pro Xaa' Ala Cys Thr Gly Cys Tyr   (SEQ ID NO: 1016)
Cys Cys Glu Tyr Xaa' Xaa' Cys Xaa' Asn Pro Xaa' Ala Xaa' Cys Thr Gly Cys Tyr   (SEQ ID NO: 1017)
Cys Cys Glu Tyr Xaa' Xaa' Cys Xaa' Asn Pro Ala Xaa' Cys Thr Gly Cys Tyr   (SEQ ID NO: 1018)
Cys Cys Glu Tyr Xaa' Xaa' Cys Xaa' Asn Pro Ala Cys Xaa' Thr Gly Cys Tyr   (SEQ ID NO: 1019)
```

FIG. 12-24

| | | | | | | | | | | | | |
|---|---|---|---|---|---|---|---|---|---|---|---|---|
| Cys | Cys | Glu | Tyr | Xaa' | Cys | Cys | Xaa' | Asn | Pro | Xaa' | Ala | Cys | Thr | Xaa' | Gly | Cys | Tyr | (SEQ ID NO:1020) |
| Cys | Cys | Glu | Tyr | Xaa' | Cys | Cys | Xaa' | Asn | Pro | Xaa' | Ala | Cys | Thr | Gly | Xaa' | Cys | Tyr | (SEQ ID NO:1021) |
| Cys | Cys | Glu | Tyr | Xaa' | Cys | Cys | Xaa' | Asn | Pro | Xaa' | Ala | Cys | Thr | Gly | Cys | Xaa' | Tyr | (SEQ ID NO:1022) |
| Cys | Cys | Glu | Tyr | Xaa' | Cys | Cys | Xaa' | Asn | Pro | Ala | Xaa' | Cys | Thr | Gly | Cys | Tyr | | (SEQ ID NO:1023) |
| Cys | Cys | Glu | Tyr | Xaa' | Cys | Cys | Xaa' | Asn | Pro | Ala | Xaa' | Cys | Thr | Gly | Cys | Tyr | | (SEQ ID NO:1024) |
| Cys | Cys | Glu | Tyr | Xaa' | Cys | Cys | Xaa' | Asn | Pro | Ala | Xaa' | Cys | Xaa' | Thr | Gly | Cys | Tyr | (SEQ ID NO:1025) |
| Cys | Cys | Glu | Tyr | Xaa' | Cys | Cys | Xaa' | Asn | Pro | Ala | Xaa' | Cys | Thr | Xaa' | Gly | Cys | Tyr | (SEQ ID NO:1026) |
| Cys | Cys | Glu | Tyr | Xaa' | Cys | Cys | Xaa' | Asn | Pro | Ala | Xaa' | Cys | Thr | Gly | Xaa' | Cys | Tyr | (SEQ ID NO:1027) |
| Cys | Cys | Glu | Tyr | Xaa' | Cys | Cys | Xaa' | Asn | Pro | Ala | Xaa' | Cys | Thr | Gly | Cys | Xaa' | Tyr | (SEQ ID NO:1028) |
| Cys | Cys | Glu | Tyr | Xaa' | Cys | Cys | Xaa' | Asn | Pro | Ala | Cys | Xaa' | Thr | Gly | Cys | Tyr | | (SEQ ID NO:1029) |
| Cys | Cys | Glu | Tyr | Xaa' | Cys | Cys | Xaa' | Asn | Pro | Ala | Cys | Xaa' | Thr | Gly | Cys | Tyr | | (SEQ ID NO:1030) |
| Cys | Cys | Glu | Tyr | Xaa' | Cys | Cys | Xaa' | Asn | Pro | Ala | Cys | Xaa' | Thr | Gly | Cys | Tyr | | (SEQ ID NO:1031) |
| Cys | Cys | Glu | Tyr | Xaa' | Cys | Cys | Xaa' | Asn | Pro | Ala | Cys | Xaa' | Thr | Gly | Cys | Tyr | | (SEQ ID NO:1032) |
| Cys | Cys | Glu | Tyr | Xaa' | Cys | Cys | Xaa' | Asn | Pro | Ala | Cys | Thr | Xaa' | Gly | Cys | Tyr | | (SEQ ID NO:1033) |
| Cys | Cys | Glu | Tyr | Xaa' | Cys | Cys | Xaa' | Asn | Pro | Ala | Cys | Thr | Gly | Cys | Tyr | | | (SEQ ID NO:1034) |
| Cys | Cys | Glu | Tyr | Xaa' | Cys | Cys | Xaa' | Asn | Pro | Ala | Cys | Thr | Xaa' | Gly | Cys | Tyr | | (SEQ ID NO:1035) |
| Cys | Cys | Glu | Tyr | Xaa' | Cys | Cys | Xaa' | Asn | Pro | Ala | Cys | Thr | Xaa' | Gly | Cys | Tyr | | (SEQ ID NO:1036) |
| Cys | Cys | Glu | Tyr | Xaa' | Cys | Cys | Xaa' | Asn | Pro | Ala | Cys | Thr | Gly | Xaa' | Cys | Tyr | | (SEQ ID NO:1037) |
| Cys | Cys | Glu | Tyr | Xaa' | Cys | Cys | Xaa' | Asn | Pro | Ala | Cys | Thr | Gly | Cys | Xaa' | Tyr | | (SEQ ID NO:1038) |
| Cys | Cys | Glu | Tyr | Xaa' | Cys | Cys | Asn | Xaa' | Pro | Ala | Cys | Thr | Gly | Cys | Tyr | | | (SEQ ID NO:1039) |
| Cys | Cys | Glu | Tyr | Xaa' | Cys | Cys | Asn | Xaa' | Pro | Ala | Cys | Thr | Gly | Cys | Tyr | | | (SEQ ID NO:1040) |
| Cys | Cys | Glu | Tyr | Xaa' | Cys | Cys | Asn | Xaa' | Pro | Ala | Cys | Thr | Gly | Cys | Xaa' | Tyr | | (SEQ ID NO:1041) |
| Cys | Cys | Glu | Tyr | Xaa' | Cys | Cys | Asn | Xaa' | Xaa' | Pro | Ala | Cys | Thr | Gly | Cys | Tyr | | (SEQ ID NO:1042) |
| Cys | Cys | Glu | Tyr | Xaa' | Cys | Cys | Asn | Xaa' | Xaa' | Pro | Ala | Cys | Thr | Gly | Cys | Xaa' | Tyr | (SEQ ID NO:1043) |
| Cys | Cys | Glu | Tyr | Xaa' | Cys | Cys | Asn | Xaa' | Pro | Xaa' | Ala | Cys | Thr | Gly | Cys | Tyr | | (SEQ ID NO:1044) |
| Cys | Cys | Glu | Tyr | Xaa' | Cys | Cys | Asn | Xaa' | Pro | Ala | Xaa' | Cys | Thr | Gly | Cys | Tyr | | (SEQ ID NO:1045) |
| Cys | Cys | Glu | Tyr | Xaa' | Cys | Cys | Asn | Xaa' | Pro | Ala | Cys | Xaa' | Thr | Gly | Cys | Tyr | | (SEQ ID NO:1046) |
| Cys | Cys | Glu | Tyr | Xaa' | Cys | Cys | Asn | Xaa' | Pro | Ala | Cys | Xaa' | Thr | Gly | Cys | Tyr | | (SEQ ID NO:1047) |
| Cys | Cys | Glu | Tyr | Xaa' | Cys | Cys | Asn | Xaa' | Pro | Ala | Cys | Xaa' | Thr | Gly | Cys | Tyr | | (SEQ ID NO:1048) |

*FIG. 12-25*

Cys Cys Glu Tyr Xaa' Cys Cys Asn Xaa' Xaa' Pro Ala Cys Thr Xaa' Gly Cys Tyr (SEQ ID NO:1049)
Cys Cys Glu Tyr Xaa' Cys Cys Asn Xaa' Xaa' Pro Ala Cys Thr Gly Xaa' Cys Tyr (SEQ ID NO:1050)
Cys Cys Glu Tyr Xaa' Cys Cys Asn Xaa' Xaa' Pro Ala Cys Thr Gly Cys Xaa' Tyr (SEQ ID NO:1051)
Cys Cys Glu Tyr Xaa' Cys Cys Asn Xaa' Xaa' Pro Ala Cys Thr Gly Cys Tyr (SEQ ID NO:1052)
Cys Cys Glu Tyr Xaa' Cys Cys Asn Xaa' Pro Xaa' Ala Cys Thr Xaa' Gly Cys Tyr (SEQ ID NO:1053)
Cys Cys Glu Tyr Xaa' Cys Cys Asn Xaa' Pro Xaa' Ala Cys Xaa' Thr Gly Cys Tyr (SEQ ID NO:1054)
Cys Cys Glu Tyr Xaa' Cys Cys Asn Xaa' Pro Xaa' Ala Xaa' Cys Thr Gly Cys Tyr (SEQ ID NO:1055)
Cys Cys Glu Tyr Xaa' Cys Cys Asn Xaa' Pro Xaa' Ala Cys Thr Xaa' Gly Cys Tyr (SEQ ID NO:1056)
Cys Cys Glu Tyr Xaa' Cys Cys Asn Xaa' Pro Xaa' Ala Cys Thr Gly Xaa' Cys Tyr (SEQ ID NO:1057)
Cys Cys Glu Tyr Xaa' Cys Cys Asn Xaa' Pro Xaa' Ala Cys Thr Gly Cys Xaa' Tyr (SEQ ID NO:1058)
Cys Cys Glu Tyr Xaa' Cys Cys Asn Xaa' Pro Ala Xaa' Cys Thr Gly Cys Tyr (SEQ ID NO:1059)
Cys Cys Glu Tyr Xaa' Cys Cys Asn Xaa' Pro Ala Xaa' Xaa' Cys Thr Gly Cys Tyr (SEQ ID NO:1060)
Cys Cys Glu Tyr Xaa' Cys Cys Asn Xaa' Pro Ala Xaa' Cys Xaa' Thr Gly Cys Tyr (SEQ ID NO:1061)
Cys Cys Glu Tyr Xaa' Cys Cys Asn Xaa' Pro Ala Xaa' Cys Thr Xaa' Gly Cys Tyr (SEQ ID NO:1062)
Cys Cys Glu Tyr Xaa' Cys Cys Asn Xaa' Pro Ala Xaa' Cys Thr Gly Xaa' Cys Tyr (SEQ ID NO:1063)
Cys Cys Glu Tyr Xaa' Cys Cys Asn Xaa' Pro Ala Xaa' Cys Thr Gly Cys Xaa' Tyr (SEQ ID NO:1064)
Cys Cys Glu Tyr Xaa' Cys Cys Asn Xaa' Pro Ala Cys Xaa' Thr Gly Cys Tyr (SEQ ID NO:1065)
Cys Cys Glu Tyr Xaa' Cys Cys Asn Xaa' Pro Ala Cys Xaa' Xaa' Thr Gly Cys Tyr (SEQ ID NO:1066)
Cys Cys Glu Tyr Xaa' Cys Cys Asn Xaa' Pro Ala Cys Xaa' Thr Xaa' Gly Cys Tyr (SEQ ID NO:1067)
Cys Cys Glu Tyr Xaa' Cys Cys Asn Xaa' Pro Ala Cys Xaa' Thr Gly Xaa' Cys Tyr (SEQ ID NO:1068)
Cys Cys Glu Tyr Xaa' Cys Cys Asn Xaa' Pro Ala Cys Xaa' Thr Gly Cys Xaa' Tyr (SEQ ID NO:1069)
Cys Cys Glu Tyr Xaa' Cys Cys Asn Xaa' Pro Ala Cys Thr Xaa' Gly Cys Tyr (SEQ ID NO:1070)
Cys Cys Glu Tyr Xaa' Cys Cys Asn Xaa' Pro Ala Cys Thr Xaa' Xaa' Gly Cys Tyr (SEQ ID NO:1071)
Cys Cys Glu Tyr Xaa' Cys Cys Asn Xaa' Pro Ala Cys Thr Xaa' Gly Xaa' Cys Tyr (SEQ ID NO:1072)
Cys Cys Glu Tyr Xaa' Cys Cys Asn Xaa' Pro Ala Cys Thr Xaa' Gly Cys Xaa' Tyr (SEQ ID NO:1073)
Cys Cys Glu Tyr Xaa' Cys Cys Asn Xaa' Pro Ala Cys Thr Gly Xaa' Cys Tyr (SEQ ID NO:1074)
Cys Cys Glu Tyr Xaa' Cys Cys Asn Xaa' Pro Ala Cys Thr Gly Xaa' Xaa' Cys Tyr (SEQ ID NO:1075)
Cys Cys Glu Tyr Xaa' Cys Cys Asn Xaa' Pro Ala Cys Thr Gly Xaa' Cys Xaa' Tyr (SEQ ID NO:1076)
Cys Cys Glu Tyr Xaa' Cys Cys Asn Xaa' Pro Ala Cys Thr Gly Cys Xaa' Tyr (SEQ ID NO:1077)

*FIG. 12-26*

Cys Cys Glu Tyr Xaa' Cys Cys Asn Xaa' Pro Ala Cys Thr Gly Cys Xaa' Xaa' Tyr (SEQ ID NO:1078)
Cys Cys Glu Tyr Xaa' Cys Cys Asn Pro Xaa' Ala Cys Thr Gly Cys Tyr (SEQ ID NO:1079)
Cys Cys Glu Tyr Xaa' Cys Cys Asn Pro Xaa' Xaa' Cys Thr Gly Cys Tyr (SEQ ID NO:1080)
Cys Cys Glu Tyr Xaa' Cys Cys Asn Pro Xaa' Xaa' Ala Cys Thr Gly Cys Tyr (SEQ ID NO:1081)
Cys Cys Glu Tyr Xaa' Cys Cys Asn Pro Xaa' Xaa' Ala Cys Thr Gly Cys Cys Tyr (SEQ ID NO:1082)
Cys Cys Glu Tyr Xaa' Cys Cys Asn Pro Xaa' Xaa' Ala Cys Xaa' Thr Gly Cys Tyr (SEQ ID NO:1083)
Cys Cys Glu Tyr Xaa' Cys Cys Asn Pro Xaa' Xaa' Ala Cys Thr Xaa' Gly Cys Tyr (SEQ ID NO:1084)
Cys Cys Glu Tyr Xaa' Cys Cys Asn Pro Xaa' Xaa' Ala Cys Thr Gly Xaa' Cys Tyr (SEQ ID NO:1085)
Cys Cys Glu Tyr Xaa' Cys Cys Asn Pro Xaa' Xaa' Ala Cys Thr Gly Cys Xaa' Tyr (SEQ ID NO:1086)
Cys Cys Glu Tyr Xaa' Cys Cys Asn Pro Xaa' Ala Xaa' Cys Thr Gly Cys Tyr (SEQ ID NO:1087)
Cys Cys Glu Tyr Xaa' Cys Cys Asn Pro Xaa' Ala Xaa' Cys Thr Gly Cys Cys Tyr (SEQ ID NO:1088)
Cys Cys Glu Tyr Xaa' Cys Cys Asn Pro Xaa' Ala Xaa' Cys Xaa' Thr Gly Cys Tyr (SEQ ID NO:1089)
Cys Cys Glu Tyr Xaa' Cys Cys Asn Pro Xaa' Ala Xaa' Cys Thr Xaa' Gly Cys Tyr (SEQ ID NO:1090)
Cys Cys Glu Tyr Xaa' Cys Cys Asn Pro Xaa' Ala Xaa' Cys Thr Gly Xaa' Cys Tyr (SEQ ID NO:1091)
Cys Cys Glu Tyr Xaa' Cys Cys Asn Pro Xaa' Ala Cys Xaa' Thr Gly Cys Tyr (SEQ ID NO:1092)
Cys Cys Glu Tyr Xaa' Cys Cys Asn Pro Xaa' Ala Cys Xaa' Thr Gly Cys Cys Tyr (SEQ ID NO:1093)
Cys Cys Glu Tyr Xaa' Cys Cys Asn Pro Xaa' Ala Cys Xaa' Thr Xaa' Gly Cys Tyr (SEQ ID NO:1094)
Cys Cys Glu Tyr Xaa' Cys Cys Asn Pro Xaa' Ala Cys Xaa' Thr Gly Xaa' Cys Tyr (SEQ ID NO:1095)
Cys Cys Glu Tyr Xaa' Cys Cys Asn Pro Xaa' Ala Cys Xaa' Thr Gly Cys Xaa' Tyr (SEQ ID NO:1096)
Cys Cys Glu Tyr Xaa' Cys Cys Asn Pro Xaa' Ala Cys Thr Xaa' Gly Cys Tyr (SEQ ID NO:1097)
Cys Cys Glu Tyr Xaa' Cys Cys Asn Pro Xaa' Ala Cys Thr Xaa' Gly Cys Cys Tyr (SEQ ID NO:1098)
Cys Cys Glu Tyr Xaa' Cys Cys Asn Pro Xaa' Ala Cys Thr Xaa' Xaa' Gly Cys Tyr (SEQ ID NO:1099)
Cys Cys Glu Tyr Xaa' Cys Cys Asn Pro Xaa' Ala Cys Thr Xaa' Gly Xaa' Cys Tyr (SEQ ID NO:1100)
Cys Cys Glu Tyr Xaa' Cys Cys Asn Pro Xaa' Ala Cys Thr Xaa' Gly Cys Xaa' Tyr (SEQ ID NO:1101)
Cys Cys Glu Tyr Xaa' Cys Cys Asn Pro Xaa' Ala Cys Thr Gly Xaa' Cys Tyr (SEQ ID NO:1102)
Cys Cys Glu Tyr Xaa' Cys Cys Asn Pro Xaa' Ala Cys Thr Gly Xaa' Xaa' Cys Tyr (SEQ ID NO:1103)
Cys Cys Glu Tyr Xaa' Cys Cys Asn Pro Xaa' Ala Cys Thr Gly Xaa' Cys Xaa' Tyr (SEQ ID NO:1104)
Cys Cys Glu Tyr Xaa' Cys Cys Asn Pro Xaa' Ala Cys Thr Gly Cys Xaa' Xaa' Tyr (SEQ ID NO:1105)
Cys Cys Glu Tyr Xaa' Cys Cys Asn Pro Ala Xaa' Cys Thr Gly Cys Tyr (SEQ ID NO:1106)

| | | | | | | | | | | |
|---|---|---|---|---|---|---|---|---|---|---|
| Cys | Cys | Glu | Tyr | Xaa' | Cys | Cys | Asn | Pro | Ala | Xaa' | Xaa' | Cys | Thr | Gly | Cys | Tyr | (SEQ ID NO:1107) |

(Due to complexity, representing as structured list:)

- Cys Cys Glu Tyr Xaa' Cys Cys Asn Pro Ala Xaa' Xaa' Cys Thr Gly Cys Tyr (SEQ ID NO:1107)
- Cys Cys Glu Tyr Xaa' Cys Cys Asn Pro Ala Xaa' Xaa' Cys Xaa' Thr Gly Cys Tyr (SEQ ID NO:1108)
- Cys Cys Glu Tyr Xaa' Cys Cys Asn Pro Ala Xaa' Xaa' Cys Xaa' Thr Gly Cys Tyr (SEQ ID NO:1109)
- Cys Cys Glu Tyr Xaa' Cys Cys Asn Pro Ala Xaa' Xaa' Cys Xaa' Gly Cys Tyr (SEQ ID NO:1110)
- Cys Cys Glu Tyr Xaa' Cys Cys Asn Pro Ala Xaa' Xaa' Cys Thr Gly Xaa' Cys Tyr (SEQ ID NO:1111)
- Cys Cys Glu Tyr Xaa' Cys Cys Asn Pro Ala Xaa' Xaa' Cys Thr Gly Xaa' Cys Tyr (SEQ ID NO:1112)
- Cys Cys Glu Tyr Xaa' Cys Cys Asn Pro Ala Xaa' Xaa' Cys Thr Gly Cys Xaa' Tyr (SEQ ID NO:1113)
- Cys Cys Glu Tyr Xaa' Cys Cys Asn Pro Ala Xaa' Xaa' Cys Thr Gly Cys Tyr (SEQ ID NO:1114)
- Cys Cys Glu Tyr Xaa' Cys Cys Asn Pro Ala Xaa' Xaa' Cys Xaa' Thr Gly Cys Tyr (SEQ ID NO:1115)
- Cys Cys Glu Tyr Xaa' Cys Cys Asn Pro Ala Xaa' Xaa' Cys Xaa' Thr Gly Xaa' Cys Tyr (SEQ ID NO:1116)
- Cys Cys Glu Tyr Xaa' Cys Cys Asn Pro Ala Xaa' Xaa' Cys Xaa' Thr Gly Cys Xaa' Tyr (SEQ ID NO:1117)
- Cys Cys Glu Tyr Xaa' Cys Cys Asn Pro Ala Xaa' Xaa' Cys Xaa' Gly Cys Tyr (SEQ ID NO:1118)
- Cys Cys Glu Tyr Xaa' Cys Cys Asn Pro Ala Xaa' Xaa' Cys Thr Xaa' Gly Cys Tyr (SEQ ID NO:1119)
- Cys Cys Glu Tyr Xaa' Cys Cys Asn Pro Ala Xaa' Xaa' Cys Thr Xaa' Gly Xaa' Cys Tyr (SEQ ID NO:1120)
- Cys Cys Glu Tyr Xaa' Cys Cys Asn Pro Ala Xaa' Xaa' Cys Thr Xaa' Gly Cys Xaa' Tyr (SEQ ID NO:1121)
- Cys Cys Glu Tyr Xaa' Cys Cys Asn Pro Ala Xaa' Xaa' Cys Thr Gly Xaa' Cys Tyr (SEQ ID NO:1122)
- Cys Cys Glu Tyr Xaa' Cys Cys Asn Pro Ala Xaa' Xaa' Cys Thr Gly Xaa' Xaa' Cys Tyr (SEQ ID NO:1123)
- Cys Cys Glu Tyr Xaa' Cys Cys Asn Pro Ala Xaa' Xaa' Cys Thr Gly Xaa' Cys Xaa' Tyr (SEQ ID NO:1124)
- Cys Cys Glu Tyr Xaa' Cys Cys Asn Pro Ala Cys Xaa' Thr Gly Cys Xaa' Tyr (SEQ ID NO:1125)
- Cys Cys Glu Tyr Xaa' Cys Cys Asn Pro Ala Cys Xaa' Xaa' Thr Gly Xaa' Cys Tyr (SEQ ID NO:1126)
- Cys Cys Glu Tyr Xaa' Cys Cys Asn Pro Ala Cys Xaa' Xaa' Thr Gly Cys Xaa' Tyr (SEQ ID NO:1127)
- Cys Cys Glu Tyr Xaa' Cys Cys Asn Pro Ala Cys Xaa' Xaa' Thr Gly Cys Tyr (SEQ ID NO:1128)
- Cys Cys Glu Tyr Xaa' Cys Cys Asn Pro Ala Cys Xaa' Xaa' Thr Gly Cys Tyr (SEQ ID NO:1129)
- Cys Cys Glu Tyr Xaa' Cys Cys Asn Pro Ala Cys Xaa' Xaa' Xaa' Thr Gly Xaa' Cys Tyr (SEQ ID NO:1130)
- Cys Cys Glu Tyr Xaa' Cys Cys Asn Pro Ala Cys Xaa' Xaa' Xaa' Thr Gly Cys Xaa' Tyr (SEQ ID NO:1131)
- Cys Cys Glu Tyr Xaa' Cys Cys Asn Pro Ala Cys Xaa' Xaa' Thr Gly Cys Tyr (SEQ ID NO:1132)
- Cys Cys Glu Tyr Xaa' Cys Cys Asn Pro Ala Cys Xaa' Thr Xaa' Xaa' Gly Cys Tyr (SEQ ID NO:1133)
- Cys Cys Glu Tyr Xaa' Cys Cys Asn Pro Ala Cys Xaa' Thr Xaa' Xaa' Gly Xaa' Cys Tyr (SEQ ID NO:1134)
- Cys Cys Glu Tyr Xaa' Cys Cys Asn Pro Ala Cys Xaa' Thr Xaa' Gly Xaa' Cys Tyr (SEQ ID NO:1135)

Cys Cys Glu Tyr Xaa' Cys Cys Asn Pro Ala Cys Xaa' Thr Xaa' Gly Cys Xaa' Tyr (SEQ ID NO:1136)
Cys Cys Glu Tyr Xaa' Cys Cys Asn Pro Ala Cys Xaa' Thr Gly Xaa' Cys Tyr (SEQ ID NO:1137)
Cys Cys Glu Tyr Xaa' Cys Cys Asn Pro Ala Cys Xaa' Thr Gly Xaa' Xaa' Cys Tyr (SEQ ID NO:1138)
Cys Cys Glu Tyr Xaa' Cys Cys Asn Pro Ala Cys Xaa' Thr Gly Xaa' Cys Xaa' Tyr (SEQ ID NO:1139)
Cys Cys Glu Tyr Xaa' Cys Cys Asn Pro Ala Cys Xaa' Thr Gly Cys Xaa' Tyr (SEQ ID NO:1140)
Cys Cys Glu Tyr Xaa' Cys Cys Asn Pro Ala Cys Xaa' Thr Gly Cys Xaa' Xaa' Tyr (SEQ ID NO:1141)
Cys Cys Glu Tyr Xaa' Cys Cys Asn Pro Ala Cys Thr Xaa' Gly Cys Tyr (SEQ ID NO:1142)
Cys Cys Glu Tyr Xaa' Cys Cys Asn Pro Ala Cys Thr Xaa' Xaa' Gly Cys Tyr (SEQ ID NO:1143)
Cys Cys Glu Tyr Xaa' Cys Cys Asn Pro Ala Cys Thr Xaa' Xaa' Xaa' Gly Cys Tyr (SEQ ID NO:1144)
Cys Cys Glu Tyr Xaa' Cys Cys Asn Pro Ala Cys Thr Xaa' Xaa' Gly Xaa' Cys Tyr (SEQ ID NO:1145)
Cys Cys Glu Tyr Xaa' Cys Cys Asn Pro Ala Cys Thr Xaa' Gly Cys Xaa' Tyr (SEQ ID NO:1146)
Cys Cys Glu Tyr Xaa' Cys Cys Asn Pro Ala Cys Thr Xaa' Gly Xaa' Cys Xaa' Tyr (SEQ ID NO:1147)
Cys Cys Glu Tyr Xaa' Cys Cys Asn Pro Ala Cys Thr Xaa' Gly Xaa' Xaa' Cys Tyr (SEQ ID NO:1148)
Cys Cys Glu Tyr Xaa' Cys Cys Asn Pro Ala Cys Thr Xaa' Xaa' Gly Xaa' Xaa' Cys Tyr (SEQ ID NO:1149)
Cys Cys Glu Tyr Xaa' Cys Cys Asn Pro Ala Cys Thr Xaa' Gly Cys Xaa' Tyr (SEQ ID NO:1150)
Cys Cys Glu Tyr Xaa' Cys Cys Asn Pro Ala Cys Thr Gly Xaa' Cys Tyr (SEQ ID NO:1151)
Cys Cys Glu Tyr Xaa' Cys Cys Asn Pro Ala Cys Thr Gly Xaa' Xaa' Cys Tyr (SEQ ID NO:1152)
Cys Cys Glu Tyr Xaa' Cys Cys Asn Pro Ala Cys Thr Gly Xaa' Xaa' Xaa' Cys Tyr (SEQ ID NO:1153)
Cys Cys Glu Tyr Xaa' Cys Cys Asn Pro Ala Cys Thr Gly Xaa' Xaa' Cys Xaa' Tyr (SEQ ID NO:1154)
Cys Cys Glu Tyr Xaa' Cys Cys Asn Pro Ala Cys Thr Gly Xaa' Cys Xaa' Tyr (SEQ ID NO:1155)
Cys Cys Glu Tyr Xaa' Cys Cys Asn Pro Ala Cys Thr Gly Cys Xaa' Tyr (SEQ ID NO:1156)
Cys Cys Glu Tyr Xaa' Cys Cys Asn Pro Ala Cys Thr Gly Cys Xaa' Xaa' Tyr (SEQ ID NO:1157)
Cys Cys Glu Tyr Xaa' Cys Cys Asn Pro Ala Cys Thr Gly Cys Xaa' Tyr (SEQ ID NO:1158)
Cys Cys Glu Tyr Xaa' Cys Cys Asn Pro Ala Cys Thr Gly Cys Xaa' Xaa' Xaa' Tyr (SEQ ID NO:1159)
Cys Cys Glu Tyr Xaa' Cys Cys Asn Pro Ala Cys Thr Gly Cys Tyr (SEQ ID NO:1160)
Cys Cys Glu Tyr Cys Xaa' Asn Pro Ala Cys Thr Gly Cys Tyr (SEQ ID NO:1161)
Cys Cys Glu Tyr Cys Xaa' Xaa' Asn Pro Ala Cys Thr Gly Cys Tyr (SEQ ID NO:1162)
Cys Cys Glu Tyr Cys Xaa' Xaa' Xaa' Asn Pro Ala Cys Thr Gly Cys Tyr (SEQ ID NO:1163)
Cys Cys Glu Tyr Cys Xaa' Xaa' Xaa' Xaa' Asn Pro Ala Cys Thr Gly Cys Tyr (SEQ ID NO:1164)

*FIG. 12-29*

| | | | | | | | | | | |
|---|---|---|---|---|---|---|---|---|---|---|
| Cys | Cys | Glu | Tyr | Cys | Cys | Xaa' | Xaa' | Asn | Xaa' | Pro | Ala | Cys | Thr | Gly | Cys | Tyr | (SEQ ID NO:1165) |
| Cys | Cys | Glu | Tyr | Cys | Cys | Xaa' | Xaa' | Asn | Pro | Xaa' | Ala | Cys | Thr | Gly | Cys | Tyr | (SEQ ID NO:1166) |
| Cys | Cys | Glu | Tyr | Cys | Cys | Xaa' | Xaa' | Asn | Pro | Ala | Xaa' | Cys | Thr | Gly | Cys | Tyr | (SEQ ID NO:1167) |
| Cys | Cys | Glu | Tyr | Cys | Cys | Xaa' | Xaa' | Asn | Pro | Ala | Cys | Xaa' | Thr | Gly | Cys | Tyr | (SEQ ID NO:1168) |
| Cys | Cys | Glu | Tyr | Cys | Cys | Xaa' | Xaa' | Asn | Pro | Ala | Cys | Thr | Xaa' | Gly | Cys | Tyr | (SEQ ID NO:1169) |
| Cys | Cys | Glu | Tyr | Cys | Cys | Xaa' | Xaa' | Asn | Pro | Ala | Cys | Thr | Gly | Xaa' | Cys | Tyr | (SEQ ID NO:1170) |
| Cys | Cys | Glu | Tyr | Cys | Cys | Xaa' | Xaa' | Asn | Pro | Ala | Cys | Thr | Gly | Cys | Xaa' | Tyr | (SEQ ID NO:1171) |
| Cys | Cys | Glu | Tyr | Cys | Cys | Xaa' | Asn | Xaa' | Xaa' | Pro | Ala | Cys | Thr | Gly | Cys | Tyr | (SEQ ID NO:1172) |
| Cys | Cys | Glu | Tyr | Cys | Cys | Xaa' | Asn | Xaa' | Pro | Xaa' | Ala | Cys | Thr | Gly | Cys | Tyr | (SEQ ID NO:1173) |
| Cys | Cys | Glu | Tyr | Cys | Cys | Xaa' | Asn | Xaa' | Pro | Ala | Xaa' | Cys | Thr | Gly | Cys | Tyr | (SEQ ID NO:1174) |
| Cys | Cys | Glu | Tyr | Cys | Cys | Xaa' | Asn | Xaa' | Pro | Ala | Cys | Xaa' | Thr | Gly | Cys | Tyr | (SEQ ID NO:1175) |
| Cys | Cys | Glu | Tyr | Cys | Cys | Xaa' | Asn | Xaa' | Pro | Ala | Cys | Thr | Xaa' | Gly | Cys | Tyr | (SEQ ID NO:1176) |
| Cys | Cys | Glu | Tyr | Cys | Cys | Xaa' | Asn | Xaa' | Pro | Ala | Cys | Thr | Gly | Xaa' | Cys | Tyr | (SEQ ID NO:1177) |
| Cys | Cys | Glu | Tyr | Cys | Cys | Xaa' | Asn | Xaa' | Pro | Ala | Cys | Thr | Gly | Cys | Xaa' | Tyr | (SEQ ID NO:1178) |
| Cys | Cys | Glu | Tyr | Cys | Cys | Xaa' | Asn | Pro | Xaa' | Xaa' | Ala | Cys | Thr | Gly | Cys | Tyr | (SEQ ID NO:1179) |
| Cys | Cys | Glu | Tyr | Cys | Cys | Xaa' | Asn | Pro | Xaa' | Ala | Xaa' | Cys | Thr | Gly | Cys | Tyr | (SEQ ID NO:1180) |
| Cys | Cys | Glu | Tyr | Cys | Cys | Xaa' | Asn | Pro | Xaa' | Ala | Cys | Xaa' | Thr | Gly | Cys | Tyr | (SEQ ID NO:1181) |
| Cys | Cys | Glu | Tyr | Cys | Cys | Xaa' | Asn | Pro | Xaa' | Ala | Cys | Thr | Xaa' | Gly | Cys | Tyr | (SEQ ID NO:1182) |
| Cys | Cys | Glu | Tyr | Cys | Cys | Xaa' | Asn | Pro | Xaa' | Ala | Cys | Thr | Gly | Xaa' | Cys | Tyr | (SEQ ID NO:1183) |
| Cys | Cys | Glu | Tyr | Cys | Cys | Xaa' | Asn | Pro | Xaa' | Ala | Cys | Thr | Gly | Cys | Xaa' | Tyr | (SEQ ID NO:1184) |
| Cys | Cys | Glu | Tyr | Cys | Cys | Xaa' | Asn | Pro | Ala | Xaa' | Xaa' | Cys | Thr | Gly | Cys | Tyr | (SEQ ID NO:1185) |
| Cys | Cys | Glu | Tyr | Cys | Cys | Xaa' | Asn | Pro | Ala | Xaa' | Cys | Xaa' | Thr | Gly | Cys | Tyr | (SEQ ID NO:1186) |
| Cys | Cys | Glu | Tyr | Cys | Cys | Xaa' | Asn | Pro | Ala | Xaa' | Cys | Thr | Xaa' | Gly | Cys | Tyr | (SEQ ID NO:1187) |
| Cys | Cys | Glu | Tyr | Cys | Cys | Xaa' | Asn | Pro | Ala | Xaa' | Cys | Thr | Gly | Xaa' | Cys | Tyr | (SEQ ID NO:1188) |
| Cys | Cys | Glu | Tyr | Cys | Cys | Xaa' | Asn | Pro | Ala | Xaa' | Cys | Thr | Gly | Cys | Xaa' | Tyr | (SEQ ID NO:1189) |
| Cys | Cys | Glu | Tyr | Cys | Cys | Xaa' | Asn | Pro | Ala | Cys | Xaa' | Xaa' | Thr | Gly | Cys | Tyr | (SEQ ID NO:1190) |
| Cys | Cys | Glu | Tyr | Cys | Cys | Xaa' | Asn | Pro | Ala | Cys | Xaa' | Thr | Xaa' | Gly | Cys | Tyr | (SEQ ID NO:1191) |
| Cys | Cys | Glu | Tyr | Cys | Cys | Xaa' | Asn | Pro | Ala | Cys | Xaa' | Thr | Gly | Xaa' | Cys | Tyr | (SEQ ID NO:1192) |
| Cys | Cys | Glu | Tyr | Cys | Cys | Xaa' | Asn | Pro | Ala | Cys | Xaa' | Thr | Gly | Cys | Xaa' | Tyr | (SEQ ID NO:1193) |

| Sequence | SEQ ID NO |
|---|---|
| Cys Cys Glu Tyr Cys Cys Xaa' Xaa' Asn Pro Ala Cys Xaa' Xaa' Thr Gly Cys Tyr | (SEQ ID NO:1194) |
| Cys Cys Glu Tyr Cys Cys Xaa' Xaa' Asn Pro Ala Cys Xaa' Thr Xaa' Gly Cys Tyr | (SEQ ID NO:1195) |
| Cys Cys Glu Tyr Cys Cys Xaa' Xaa' Asn Pro Ala Cys Xaa' Thr Gly Xaa' Cys Tyr | (SEQ ID NO:1196) |
| Cys Cys Glu Tyr Cys Cys Xaa' Xaa' Asn Pro Ala Cys Xaa' Thr Gly Cys Xaa' Tyr | (SEQ ID NO:1197) |
| Cys Cys Glu Tyr Cys Cys Xaa' Xaa' Asn Pro Ala Cys Thr Gly Cys Tyr | (SEQ ID NO:1198) |
| Cys Cys Glu Tyr Cys Cys Xaa' Xaa' Asn Pro Ala Cys Xaa' Gly Cys Tyr | (SEQ ID NO:1199) |
| Cys Cys Glu Tyr Cys Cys Xaa' Xaa' Asn Pro Ala Cys Xaa' Thr Xaa' Cys Tyr | (SEQ ID NO:1200) |
| Cys Cys Glu Tyr Cys Cys Xaa' Xaa' Asn Pro Ala Cys Xaa' Thr Gly Cys Xaa' Tyr | (SEQ ID NO:1201) |
| Cys Cys Glu Tyr Cys Cys Xaa' Xaa' Asn Pro Ala Cys Thr Gly Xaa' Cys Tyr | (SEQ ID NO:1202) |
| Cys Cys Glu Tyr Cys Cys Xaa' Xaa' Asn Pro Ala Cys Xaa' Gly Xaa' Cys Tyr | (SEQ ID NO:1203) |
| Cys Cys Glu Tyr Cys Cys Xaa' Xaa' Asn Pro Ala Cys Xaa' Thr Xaa' Cys Tyr | (SEQ ID NO:1204) |
| Cys Cys Glu Tyr Cys Cys Xaa' Xaa' Asn Pro Ala Cys Thr Gly Cys Tyr | (SEQ ID NO:1205) |
| Cys Cys Glu Tyr Cys Cys Xaa' Asn Xaa' Pro Ala Cys Xaa' Thr Gly Cys Xaa' Tyr | (SEQ ID NO:1206) |
| Cys Cys Glu Tyr Cys Cys Xaa' Asn Xaa' Pro Ala Cys Thr Gly Cys Tyr | (SEQ ID NO:1207) |
| Cys Cys Glu Tyr Cys Cys Xaa' Asn Xaa' Xaa' Pro Ala Cys Thr Gly Cys Tyr | (SEQ ID NO:1208) |
| Cys Cys Glu Tyr Cys Cys Xaa' Asn Xaa' Pro Xaa' Ala Cys Thr Gly Cys Tyr | (SEQ ID NO:1209) |
| Cys Cys Glu Tyr Cys Cys Xaa' Asn Xaa' Pro Ala Xaa' Cys Thr Gly Cys Tyr | (SEQ ID NO:1210) |
| Cys Cys Glu Tyr Cys Cys Xaa' Asn Xaa' Pro Ala Cys Xaa' Thr Gly Cys Tyr | (SEQ ID NO:1211) |
| Cys Cys Glu Tyr Cys Cys Xaa' Asn Xaa' Pro Ala Cys Thr Xaa' Gly Cys Tyr | (SEQ ID NO:1212) |
| Cys Cys Glu Tyr Cys Cys Xaa' Asn Xaa' Pro Ala Cys Thr Gly Xaa' Cys Tyr | (SEQ ID NO:1213) |
| Cys Cys Glu Tyr Cys Cys Xaa' Asn Xaa' Pro Ala Cys Thr Gly Cys Xaa' Tyr | (SEQ ID NO:1214) |
| Cys Cys Glu Tyr Cys Cys Xaa' Asn Xaa' Pro Ala Cys Thr Gly Cys Xaa' Tyr | (SEQ ID NO:1215) |
| Cys Cys Glu Tyr Cys Cys Xaa' Asn Xaa' Pro Xaa' Ala Cys Thr Gly Cys Tyr | (SEQ ID NO:1216) |
| Cys Cys Glu Tyr Cys Cys Xaa' Asn Xaa' Pro Ala Xaa' Cys Thr Gly Cys Tyr | (SEQ ID NO:1217) |
| Cys Cys Glu Tyr Cys Cys Xaa' Asn Xaa' Pro Ala Cys Xaa' Thr Gly Cys Tyr | (SEQ ID NO:1218) |
| Cys Cys Glu Tyr Cys Cys Xaa' Asn Xaa' Pro Ala Cys Thr Xaa' Gly Cys Tyr | (SEQ ID NO:1219) |
| Cys Cys Glu Tyr Cys Cys Xaa' Asn Xaa' Pro Ala Cys Thr Gly Xaa' Cys Tyr | (SEQ ID NO:1220) |
| Cys Cys Glu Tyr Cys Cys Xaa' Asn Xaa' Pro Ala Cys Thr Gly Cys Xaa' Tyr | (SEQ ID NO:1221) |
| Cys Cys Glu Tyr Cys Cys Xaa' Asn Xaa' Pro Ala Cys Thr Gly Cys Xaa' Tyr | (SEQ ID NO:1222) |

```
Cys Cys Glu Tyr Cys Cys Xaa' Asn Xaa' Pro Ala Xaa' Cys Thr Gly Cys Tyr      (SEQ ID NO:1223)
Cys Cys Glu Tyr Cys Cys Xaa' Asn Xaa' Pro Ala Xaa' Xaa' Cys Thr Gly Cys Tyr  (SEQ ID NO:1224)
Cys Cys Glu Tyr Cys Cys Xaa' Asn Xaa' Pro Ala Xaa' Cys Xaa' Thr Gly Cys Tyr  (SEQ ID NO:1225)
Cys Cys Glu Tyr Cys Cys Xaa' Asn Xaa' Pro Ala Xaa' Cys Thr Xaa' Gly Cys Tyr  (SEQ ID NO:1226)
Cys Cys Glu Tyr Cys Cys Xaa' Asn Xaa' Pro Ala Xaa' Cys Thr Gly Xaa' Cys Tyr  (SEQ ID NO:1227)
Cys Cys Glu Tyr Cys Cys Xaa' Asn Xaa' Pro Ala Xaa' Cys Thr Gly Cys Xaa' Tyr  (SEQ ID NO:1228)
Cys Cys Glu Tyr Cys Cys Xaa' Asn Xaa' Pro Ala Cys Xaa' Thr Gly Cys Tyr       (SEQ ID NO:1229)
Cys Cys Glu Tyr Cys Cys Xaa' Asn Xaa' Pro Ala Cys Xaa' Xaa' Thr Gly Cys Tyr  (SEQ ID NO:1230)
Cys Cys Glu Tyr Cys Cys Xaa' Asn Xaa' Pro Ala Cys Xaa' Thr Xaa' Gly Cys Tyr  (SEQ ID NO:1231)
Cys Cys Glu Tyr Cys Cys Xaa' Asn Xaa' Pro Ala Cys Xaa' Thr Gly Xaa' Cys Tyr  (SEQ ID NO:1232)
Cys Cys Glu Tyr Cys Cys Xaa' Asn Xaa' Pro Ala Cys Xaa' Thr Gly Cys Xaa' Tyr  (SEQ ID NO:1233)
Cys Cys Glu Tyr Cys Cys Xaa' Asn Xaa' Pro Ala Cys Thr Xaa' Gly Cys Tyr       (SEQ ID NO:1234)
Cys Cys Glu Tyr Cys Cys Xaa' Asn Xaa' Pro Ala Cys Thr Xaa' Xaa' Gly Cys Tyr  (SEQ ID NO:1235)
Cys Cys Glu Tyr Cys Cys Xaa' Asn Xaa' Pro Ala Cys Thr Xaa' Gly Xaa' Cys Tyr  (SEQ ID NO:1236)
Cys Cys Glu Tyr Cys Cys Xaa' Asn Xaa' Pro Ala Cys Thr Xaa' Gly Cys Xaa' Tyr  (SEQ ID NO:1237)
Cys Cys Glu Tyr Cys Cys Xaa' Asn Xaa' Pro Ala Cys Thr Gly Xaa' Cys Tyr       (SEQ ID NO:1238)
Cys Cys Glu Tyr Cys Cys Xaa' Asn Xaa' Pro Ala Cys Thr Gly Xaa' Xaa' Cys Tyr  (SEQ ID NO:1239)
Cys Cys Glu Tyr Cys Cys Xaa' Asn Xaa' Pro Ala Cys Thr Gly Xaa' Cys Xaa' Tyr  (SEQ ID NO:1240)
Cys Cys Glu Tyr Cys Cys Xaa' Asn Pro Xaa' Ala Cys Thr Gly Cys Xaa' Tyr       (SEQ ID NO:1241)
Cys Cys Glu Tyr Cys Cys Xaa' Asn Pro Xaa' Ala Cys Thr Gly Cys Xaa' Xaa' Tyr  (SEQ ID NO:1242)
Cys Cys Glu Tyr Cys Cys Xaa' Asn Pro Xaa' Ala Cys Thr Gly Cys Tyr            (SEQ ID NO:1243)
Cys Cys Glu Tyr Cys Cys Xaa' Asn Pro Xaa' Xaa' Ala Cys Thr Gly Cys Tyr       (SEQ ID NO:1244)
Cys Cys Glu Tyr Cys Cys Xaa' Asn Pro Xaa' Ala Xaa' Cys Thr Gly Cys Tyr       (SEQ ID NO:1245)
Cys Cys Glu Tyr Cys Cys Xaa' Asn Pro Xaa' Ala Cys Xaa' Thr Gly Cys Tyr       (SEQ ID NO:1246)
Cys Cys Glu Tyr Cys Cys Xaa' Asn Pro Xaa' Ala Cys Thr Xaa' Gly Cys Tyr       (SEQ ID NO:1247)
Cys Cys Glu Tyr Cys Cys Xaa' Asn Pro Xaa' Ala Cys Thr Gly Xaa' Cys Tyr       (SEQ ID NO:1248)
Cys Cys Glu Tyr Cys Cys Xaa' Asn Pro Xaa' Ala Cys Thr Gly Cys Xaa' Tyr       (SEQ ID NO:1249)
Cys Cys Glu Tyr Cys Cys Xaa' Asn Pro Xaa' Ala Xaa' Cys Thr Gly Cys Xaa' Tyr  (SEQ ID NO:1250)
Cys Cys Glu Tyr Cys Cys Xaa' Asn Pro Xaa' Ala Xaa' Cys Thr Gly Cys Tyr       (SEQ ID NO:1251)
```

*FIG. 12-32*

Cys Cys Glu Tyr Cys Cys Xaa' Asn Pro Xaa' Ala Xaa' Xaa' Cys Thr Gly Cys Tyr (SEQ ID NO:1252)
Cys Cys Glu Tyr Cys Cys Xaa' Asn Pro Xaa' Ala Xaa' Cys Xaa' Thr Gly Cys Tyr (SEQ ID NO:1253)
Cys Cys Glu Tyr Cys Cys Xaa' Asn Pro Xaa' Ala Xaa' Cys Thr Xaa' Gly Cys Tyr (SEQ ID NO:1254)
Cys Cys Glu Tyr Cys Cys Xaa' Asn Pro Xaa' Ala Xaa' Cys Thr Gly Xaa' Cys Tyr (SEQ ID NO:1255)
Cys Cys Glu Tyr Cys Cys Xaa' Asn Pro Xaa' Ala Xaa' Cys Thr Gly Cys Xaa' Tyr (SEQ ID NO:1256)
Cys Cys Glu Tyr Cys Cys Xaa' Asn Pro Xaa' Ala Cys Xaa' Thr Gly Cys Tyr (SEQ ID NO:1257)
Cys Cys Glu Tyr Cys Cys Xaa' Asn Pro Xaa' Ala Cys Xaa' Xaa' Thr Gly Cys Tyr (SEQ ID NO:1258)
Cys Cys Glu Tyr Cys Cys Xaa' Asn Pro Xaa' Ala Cys Xaa' Thr Xaa' Gly Cys Tyr (SEQ ID NO:1259)
Cys Cys Glu Tyr Cys Cys Xaa' Asn Pro Xaa' Ala Cys Xaa' Thr Gly Xaa' Cys Tyr (SEQ ID NO:1260)
Cys Cys Glu Tyr Cys Cys Xaa' Asn Pro Xaa' Ala Cys Xaa' Thr Gly Cys Xaa' Tyr. (SEQ ID NO:1261)
Cys Cys Glu Tyr Cys Cys Xaa' Asn Pro Xaa' Ala Cys Thr Xaa' Gly Cys Tyr (SEQ ID NO:1262)
Cys Cys Glu Tyr Cys Cys Xaa' Asn Pro Xaa' Ala Cys Thr Xaa' Xaa' Gly Cys Tyr (SEQ ID NO:1263)
Cys Cys Glu Tyr Cys Cys Xaa' Asn Pro Xaa' Ala Cys Thr Xaa' Gly Xaa' Cys Tyr (SEQ ID NO:1264)
Cys Cys Glu Tyr Cys Cys Xaa' Asn Pro Xaa' Ala Cys Thr Xaa' Gly Cys Xaa' Tyr (SEQ ID NO:1265)
Cys Cys Glu Tyr Cys Cys Xaa' Asn Pro Xaa' Ala Cys Thr Gly Xaa' Cys Tyr (SEQ ID NO:1266)
Cys Cys Glu Tyr Cys Cys Xaa' Asn Pro Xaa' Ala Cys Thr Gly Xaa' Xaa' Cys Tyr (SEQ ID NO:1267)
Cys Cys Glu Tyr Cys Cys Xaa' Asn Pro Xaa' Ala Cys Thr Gly Xaa' Cys Xaa' Tyr (SEQ ID NO:1268)
Cys Cys Glu Tyr Cys Cys Xaa' Asn Pro Xaa' Ala Cys Thr Gly Cys Xaa' Tyr (SEQ ID NO:1269)
Cys Cys Glu Tyr Cys Cys Xaa' Asn Pro Ala Xaa' Cys Thr Gly Cys Tyr (SEQ ID NO:1270)
Cys Cys Glu Tyr Cys Cys Xaa' Asn Pro Ala Xaa' Xaa' Cys Thr Gly Cys Tyr (SEQ ID NO:1271)
Cys Cys Glu Tyr Cys Cys Xaa' Asn Pro Ala Xaa' Cys Xaa' Thr Gly Cys Tyr (SEQ ID NO:1272)
Cys Cys Glu Tyr Cys Cys Xaa' Asn Pro Ala Xaa' Cys Thr Xaa' Gly Cys Tyr (SEQ ID NO:1273)
Cys Cys Glu Tyr Cys Cys Xaa' Asn Pro Ala Xaa' Cys Thr Gly Xaa' Cys Tyr (SEQ ID NO:1274)
Cys Cys Glu Tyr Cys Cys Xaa' Asn Pro Ala Xaa' Cys Thr Gly Cys Xaa' Tyr (SEQ ID NO:1275)
Cys Cys Glu Tyr Cys Cys Xaa' Asn Pro Ala Cys Xaa' Thr Gly Cys Tyr (SEQ ID NO:1276)
Cys Cys Glu Tyr Cys Cys Xaa' Asn Pro Ala Cys Xaa' Xaa' Thr Gly Cys Tyr (SEQ ID NO:1277)
Cys Cys Glu Tyr Cys Cys Xaa' Asn Pro Ala Cys Xaa' Thr Xaa' Gly Cys Tyr (SEQ ID NO:1278)
Cys Cys Glu Tyr Cys Cys Xaa' Asn Pro Ala Cys Xaa' Thr Gly Xaa' Cys Tyr (SEQ ID NO:1279)
Cys Cys Glu Tyr Cys Cys Xaa' Asn Pro Ala Cys Xaa' Thr Gly Cys Xaa' Tyr (SEQ ID NO:1280)

FIG. 12-33

| | | | | | | | | | | | |
|---|---|---|---|---|---|---|---|---|---|---|---|
| Cys | Cys | Glu | Tyr | Cys | Cys | Xaa' | Asn | Pro | Ala | Xaa' | Cys | Xaa' | Thr | Gly | Xaa' | Cys | Tyr | (SEQ ID NO:1281) |

Figure too dense — see structured table below.

| # | Sequence | SEQ ID NO |
|---|---|---|
| 1 | Cys Cys Glu Tyr Cys Cys Xaa' Asn Pro Ala Xaa' Cys Xaa' Thr Gly Xaa' Cys Tyr | 1281 |
| 2 | Cys Cys Glu Tyr Cys Cys Xaa' Asn Pro Ala Xaa' Cys Xaa' Thr Gly Cys Xaa' Tyr | 1282 |
| 3 | Cys Cys Glu Tyr Cys Cys Xaa' Asn Pro Ala Xaa' Cys Thr Xaa' Gly Cys Tyr | 1283 |
| 4 | Cys Cys Glu Tyr Cys Cys Xaa' Asn Pro Ala Xaa' Cys Thr Xaa' Gly Cys Tyr | 1284 |
| 5 | Cys Cys Glu Tyr Cys Cys Xaa' Asn Pro Ala Xaa' Cys Xaa' Thr Xaa' Gly Cys Tyr | 1285 |
| 6 | Cys Cys Glu Tyr Cys Cys Xaa' Asn Pro Ala Xaa' Cys Xaa' Thr Xaa' Gly Xaa' Cys Tyr | 1286 |
| 7 | Cys Cys Glu Tyr Cys Cys Xaa' Asn Pro Ala Xaa' Cys Xaa' Thr Gly Xaa' Cys Tyr | 1287 |
| 8 | Cys Cys Glu Tyr Cys Cys Xaa' Asn Pro Ala Xaa' Cys Xaa' Thr Gly Xaa' Cys Tyr | 1288 |
| 9 | Cys Cys Glu Tyr Cys Cys Xaa' Asn Pro Ala Xaa' Cys Xaa' Thr Gly Xaa' Cys Tyr | 1289 |
| 10 | Cys Cys Glu Tyr Cys Cys Xaa' Asn Pro Ala Xaa' Cys Thr Gly Cys Xaa' Tyr | 1290 |
| 11 | Cys Cys Glu Tyr Cys Cys Xaa' Asn Pro Ala Cys Xaa' Thr Gly Cys Tyr | 1291 |
| 12 | Cys Cys Glu Tyr Cys Cys Xaa' Asn Pro Ala Cys Xaa' Thr Gly Cys Tyr | 1292 |
| 13 | Cys Cys Glu Tyr Cys Cys Xaa' Asn Pro Ala Cys Xaa' Xaa' Thr Gly Cys Tyr | 1293 |
| 14 | Cys Cys Glu Tyr Cys Cys Xaa' Asn Pro Ala Cys Xaa' Xaa' Thr Gly Cys Tyr | 1294 |
| 15 | Cys Cys Glu Tyr Cys Cys Xaa' Asn Pro Ala Cys Xaa' Xaa' Thr Gly Cys Tyr | 1295 |
| 16 | Cys Cys Glu Tyr Cys Cys Xaa' Asn Pro Ala Cys Xaa' Thr Gly Xaa' Cys Tyr | 1296 |
| 17 | Cys Cys Glu Tyr Cys Cys Xaa' Asn Pro Ala Cys Xaa' Thr Gly Xaa' Cys Tyr | 1297 |
| 18 | Cys Cys Glu Tyr Cys Cys Xaa' Asn Pro Ala Cys Xaa' Thr Xaa' Gly Cys Tyr | 1298 |
| 19 | Cys Cys Glu Tyr Cys Cys Xaa' Asn Pro Ala Cys Xaa' Xaa' Thr Gly Xaa' Cys Tyr | 1299 |
| 20 | Cys Cys Glu Tyr Cys Cys Xaa' Asn Pro Ala Cys Xaa' Xaa' Thr Gly Xaa' Cys Tyr | 1300 |
| 21 | Cys Cys Glu Tyr Cys Cys Xaa' Asn Pro Ala Cys Xaa' Thr Xaa' Gly Cys Tyr | 1301 |
| 22 | Cys Cys Glu Tyr Cys Cys Xaa' Asn Pro Ala Cys Xaa' Xaa' Gly Xaa' Cys Tyr | 1302 |
| 23 | Cys Cys Glu Tyr Cys Cys Xaa' Asn Pro Ala Cys Xaa' Xaa' Gly Xaa' Cys Tyr | 1303 |
| 24 | Cys Cys Glu Tyr Cys Cys Xaa' Asn Pro Ala Cys Xaa' Thr Xaa' Cys Xaa' Tyr | 1304 |
| 25 | Cys Cys Glu Tyr Cys Cys Xaa' Asn Pro Ala Cys Xaa' Thr Xaa' Cys Xaa' Tyr | 1305 |
| 26 | Cys Cys Glu Tyr Cys Cys Xaa' Asn Pro Ala Cys Thr Xaa' Gly Cys Tyr | 1306 |
| 27 | Cys Cys Glu Tyr Cys Cys Xaa' Asn Pro Ala Cys Thr Xaa' Xaa' Gly Cys Tyr | 1307 |
| 28 | Cys Cys Glu Tyr Cys Cys Xaa' Asn Pro Ala Cys Thr Xaa' Xaa' Gly Cys Tyr | 1308 |
| 29 | Cys Cys Glu Tyr Cys Cys Xaa' Asn Pro Ala Cys Thr Xaa' Xaa' Gly Cys Tyr | 1309 |

FIG. 12-34

Cys Cys Glu Tyr Cys Cys Xaa' Asn Pro Ala Cys Thr Xaa' Xaa' Gly Xaa' Cys Tyr (SEQ ID NO:1310)
Cys Cys Glu Tyr Cys Cys Xaa' Asn Pro Ala Cys Thr Xaa' Xaa' Gly Cys Xaa' Tyr (SEQ ID NO:1311)
Cys Cys Glu Tyr Cys Cys Xaa' Asn Pro Ala Cys Thr Xaa' Gly Xaa' Cys Tyr (SEQ ID NO:1312)
Cys Cys Glu Tyr Cys Cys Xaa' Asn Pro Ala Cys Thr Xaa' Gly Xaa' Xaa' Cys Tyr (SEQ ID NO:1313)
Cys Cys Glu Tyr Cys Cys Xaa' Asn Pro Ala Cys Thr Xaa' Gly Xaa' Cys Xaa' Tyr (SEQ ID NO:1314)
Cys Cys Glu Tyr Cys Cys Xaa' Asn Pro Ala Cys Thr Gly Xaa' Xaa' Cys Xaa' Tyr (SEQ ID NO:1315)
Cys Cys Glu Tyr Cys Cys Xaa' Asn Pro Ala Cys Thr Gly Xaa' Cys Xaa' Tyr (SEQ ID NO:1316)
Cys Cys Glu Tyr Cys Cys Xaa' Asn Pro Ala Cys Thr Gly Xaa' Xaa' Cys Tyr (SEQ ID NO:1317)
Cys Cys Glu Tyr Cys Cys Xaa' Asn Pro Ala Cys Thr Gly Xaa' Xaa' Xaa' Cys Tyr (SEQ ID NO:1318)
Cys Cys Glu Tyr Cys Cys Xaa' Asn Pro Ala Cys Thr Gly Xaa' Xaa' Xaa' Cys Tyr (SEQ ID NO:1319)
Cys Cys Glu Tyr Cys Cys Xaa' Asn Pro Ala Cys Thr Gly Xaa' Xaa' Xaa' Cys Tyr (SEQ ID NO:1320)
Cys Cys Glu Tyr Cys Cys Xaa' Asn Pro Ala Cys Thr Gly Xaa' Cys Xaa' Tyr (SEQ ID NO:1321)
Cys Cys Glu Tyr Cys Cys Xaa' Asn Pro Ala Cys Thr Gly Xaa' Cys Xaa' Tyr (SEQ ID NO:1322)
Cys Cys Glu Tyr Cys Cys Xaa' Asn Pro Ala Cys Thr Gly Cys Xaa' Xaa' Tyr (SEQ ID NO:1323)
Cys Cys Glu Tyr Cys Cys Asn Xaa' Pro Ala Cys Thr Gly Xaa' Xaa' Xaa' Cys Tyr (SEQ ID NO:1324)
Cys Cys Glu Tyr Cys Cys Asn Xaa' Pro Ala Cys Thr Gly Cys Xaa' Xaa' Tyr (SEQ ID NO:1325)
Cys Cys Glu Tyr Cys Cys Asn Xaa' Pro Ala Cys Thr Gly Cys Tyr (SEQ ID NO:1326)
Cys Cys Glu Tyr Cys Cys Asn Xaa' Xaa' Pro Ala Cys Thr Gly Cys Tyr (SEQ ID NO:1327)
Cys Cys Glu Tyr Cys Cys Asn Xaa' Xaa' Pro Ala Cys Thr Gly Cys Tyr (SEQ ID NO:1328)
Cys Cys Glu Tyr Cys Cys Asn Xaa' Xaa' Pro Ala Cys Thr Ala Cys Gly Cys Tyr (SEQ ID NO:1329)
Cys Cys Glu Tyr Cys Cys Asn Xaa' Xaa' Pro Ala Xaa' Cys Thr Ala Cys Gly Cys Tyr (SEQ ID NO:1330)
Cys Cys Glu Tyr Cys Cys Asn Xaa' Xaa' Pro Ala Xaa' Cys Thr Ala Cys Gly Cys Tyr (SEQ ID NO:1331)
Cys Cys Glu Tyr Cys Cys Asn Xaa' Xaa' Pro Ala Xaa' Cys Thr Xaa' Cys Gly Cys Tyr (SEQ ID NO:1332)
Cys Cys Glu Tyr Cys Cys Asn Xaa' Xaa' Pro Ala Xaa' Cys Thr Xaa' Cys Gly Cys Tyr (SEQ ID NO:1333)
Cys Cys Glu Tyr Cys Cys Asn Xaa' Xaa' Pro Ala Xaa' Cys Thr Xaa' Cys Gly Xaa' Tyr (SEQ ID NO:1334)
Cys Cys Glu Tyr Cys Cys Asn Xaa' Xaa' Pro Ala Xaa' Cys Thr Xaa' Cys Gly Cys Tyr (SEQ ID NO:1335)
Cys Cys Glu Tyr Cys Cys Asn Xaa' Xaa' Pro Ala Xaa' Cys Ala Xaa' Cys Thr Gly Cys Tyr (SEQ ID NO:1336)
Cys Cys Glu Tyr Cys Cys Asn Xaa' Xaa' Pro Xaa' Ala Xaa' Cys Thr Gly Cys Tyr (SEQ ID NO:1337)
Cys Cys Glu Tyr Cys Cys Asn Xaa' Xaa' Pro Xaa' Ala Xaa' Cys Thr Gly Cys Tyr (SEQ ID NO:1338)

FIG. 12-35

| | | | | | | | | | | |
|---|---|---|---|---|---|---|---|---|---|---|
| Cys | Cys | Glu | Tyr | Cys | Cys | Asn | Xaa' | Xaa' | Pro | Xaa' | Ala | Cys | Xaa' | Thr | Gly | Cys | Tyr | (SEQ ID NO:1339) |
| Cys | Cys | Glu | Tyr | Cys | Cys | Asn | Xaa' | Xaa' | Pro | Xaa' | Ala | Cys | Thr | Xaa' | Gly | Cys | Tyr | (SEQ ID NO:1340) |
| Cys | Cys | Glu | Tyr | Cys | Cys | Asn | Xaa' | Xaa' | Pro | Xaa' | Ala | Cys | Thr | Gly | Xaa' | Cys | Tyr | (SEQ ID NO:1341) |
| Cys | Cys | Glu | Tyr | Cys | Cys | Asn | Xaa' | Xaa' | Pro | Xaa' | Ala | Cys | Thr | Gly | Cys | Xaa' | Tyr | (SEQ ID NO:1342) |
| Cys | Cys | Glu | Tyr | Cys | Cys | Asn | Xaa' | Xaa' | Pro | Ala | Xaa' | Cys | Thr | Gly | Cys | Tyr | | (SEQ ID NO:1343) |
| Cys | Cys | Glu | Tyr | Cys | Cys | Asn | Xaa' | Xaa' | Pro | Ala | Xaa' | Xaa' | Cys | Thr | Gly | Cys | Tyr | (SEQ ID NO:1344) |
| Cys | Cys | Glu | Tyr | Cys | Cys | Asn | Xaa' | Xaa' | Pro | Ala | Xaa' | Cys | Thr | Xaa' | Gly | Cys | Tyr | (SEQ ID NO:1345) |
| Cys | Cys | Glu | Tyr | Cys | Cys | Asn | Xaa' | Xaa' | Pro | Ala | Xaa' | Cys | Thr | Gly | Xaa' | Cys | Tyr | (SEQ ID NO:1346) |
| Cys | Cys | Glu | Tyr | Cys | Cys | Asn | Xaa' | Xaa' | Pro | Ala | Xaa' | Cys | Thr | Gly | Cys | Xaa' | Tyr | (SEQ ID NO:1347) |
| Cys | Cys | Glu | Tyr | Cys | Cys | Asn | Xaa' | Xaa' | Pro | Ala | Cys | Xaa' | Thr | Gly | Cys | Tyr | | (SEQ ID NO:1348) |
| Cys | Cys | Glu | Tyr | Cys | Cys | Asn | Xaa' | Xaa' | Pro | Ala | Cys | Xaa' | Xaa' | Thr | Gly | Cys | Tyr | (SEQ ID NO:1349) |
| Cys | Cys | Glu | Tyr | Cys | Cys | Asn | Xaa' | Xaa' | Pro | Ala | Cys | Xaa' | Thr | Xaa' | Gly | Cys | Tyr | (SEQ ID NO:1350) |
| Cys | Cys | Glu | Tyr | Cys | Cys | Asn | Xaa' | Xaa' | Pro | Ala | Cys | Xaa' | Thr | Gly | Xaa' | Cys | Tyr | (SEQ ID NO:1351) |
| Cys | Cys | Glu | Tyr | Cys | Cys | Asn | Xaa' | Xaa' | Pro | Ala | Cys | Xaa' | Thr | Gly | Cys | Xaa' | Tyr | (SEQ ID NO:1352) |
| Cys | Cys | Glu | Tyr | Cys | Cys | Asn | Xaa' | Xaa' | Pro | Ala | Cys | Thr | Xaa' | Gly | Cys | Tyr | | (SEQ ID NO:1353) |
| Cys | Cys | Glu | Tyr | Cys | Cys | Asn | Xaa' | Xaa' | Pro | Ala | Cys | Thr | Xaa' | Xaa' | Gly | Cys | Tyr | (SEQ ID NO:1354) |
| Cys | Cys | Glu | Tyr | Cys | Cys | Asn | Xaa' | Xaa' | Pro | Ala | Cys | Thr | Xaa' | Gly | Xaa' | Cys | Tyr | (SEQ ID NO:1355) |
| Cys | Cys | Glu | Tyr | Cys | Cys | Asn | Xaa' | Xaa' | Pro | Ala | Cys | Thr | Xaa' | Gly | Cys | Xaa' | Tyr | (SEQ ID NO:1356) |
| Cys | Cys | Glu | Tyr | Cys | Cys | Asn | Xaa' | Xaa' | Pro | Ala | Cys | Thr | Gly | Xaa' | Cys | Tyr | | (SEQ ID NO:1357) |
| Cys | Cys | Glu | Tyr | Cys | Cys | Asn | Xaa' | Xaa' | Pro | Ala | Cys | Thr | Gly | Xaa' | Xaa' | Cys | Tyr | (SEQ ID NO:1358) |
| Cys | Cys | Glu | Tyr | Cys | Cys | Asn | Xaa' | Xaa' | Pro | Ala | Cys | Thr | Gly | Xaa' | Cys | Xaa' | Tyr | (SEQ ID NO:1359) |
| Cys | Cys | Glu | Tyr | Cys | Cys | Asn | Xaa' | Xaa' | Pro | Ala | Cys | Thr | Gly | Cys | Xaa' | Tyr | | (SEQ ID NO:1360) |
| Cys | Cys | Glu | Tyr | Cys | Cys | Asn | Xaa' | Xaa' | Pro | Ala | Cys | Thr | Gly | Cys | Xaa' | Xaa' | Tyr | (SEQ ID NO:1361) |
| Cys | Cys | Glu | Tyr | Cys | Cys | Asn | Xaa' | Xaa' | Pro | Ala | Cys | Thr | Gly | Cys | Xaa' | Xaa' | Tyr | (SEQ ID NO:1362) |
| Cys | Cys | Glu | Tyr | Cys | Cys | Asn | Xaa' | Pro | Xaa' | Xaa' | Ala | Cys | Thr | Gly | Cys | Tyr | | (SEQ ID NO:1363) |
| Cys | Cys | Glu | Tyr | Cys | Cys | Asn | Xaa' | Pro | Xaa' | Xaa' | Xaa' | Ala | Cys | Thr | Gly | Cys | Tyr | (SEQ ID NO:1364) |
| Cys | Cys | Glu | Tyr | Cys | Cys | Asn | Xaa' | Pro | Xaa' | Xaa' | Ala | Xaa' | Cys | Thr | Gly | Cys | Tyr | (SEQ ID NO:1365) |
| Cys | Cys | Glu | Tyr | Cys | Cys | Asn | Xaa' | Pro | Xaa' | Xaa' | Ala | Cys | Xaa' | Thr | Gly | Cys | Tyr | (SEQ ID NO:1366) |
| Cys | Cys | Glu | Tyr | Cys | Cys | Asn | Xaa' | Pro | Xaa' | Xaa' | Ala | Cys | Xaa' | Thr | Gly | Cys | Tyr | (SEQ ID NO:1367) |

*FIG. 12-36*

| | | | | | | | | | | |
|---|---|---|---|---|---|---|---|---|---|---|
|Cys|Cys|Glu|Tyr|Cys|Cys|Asn|Xaa'|Pro|Xaa'|Xaa'|Ala|Cys|Thr|Xaa'|Gly|Cys|Tyr|(SEQ ID NO:1368)|
|Cys|Cys|Glu|Tyr|Cys|Cys|Asn|Xaa'|Pro|Xaa'|Xaa'|Ala|Cys|Thr|Gly|Xaa'|Cys|Tyr|(SEQ ID NO:1369)|
|Cys|Cys|Glu|Tyr|Cys|Cys|Asn|Xaa'|Pro|Xaa'|Ala|Xaa'|Cys|Thr|Gly|Cys|Xaa'|Tyr|(SEQ ID NO:1370)|
|Cys|Cys|Glu|Tyr|Cys|Cys|Asn|Xaa'|Pro|Xaa'|Ala|Xaa'|Cys|Thr|Gly|Cys|Xaa'|Tyr|(SEQ ID NO:1371)|
|Cys|Cys|Glu|Tyr|Cys|Cys|Asn|Xaa'|Pro|Xaa'|Ala|Xaa'|Cys|Xaa'|Thr|Gly|Cys|Tyr|(SEQ ID NO:1372)|
|Cys|Cys|Glu|Tyr|Cys|Cys|Asn|Xaa'|Pro|Xaa'|Ala|Xaa'|Cys|Xaa'|Thr|Gly|Cys|Tyr|(SEQ ID NO:1373)|
|Cys|Cys|Glu|Tyr|Cys|Cys|Asn|Xaa'|Pro|Xaa'|Ala|Xaa'|Cys|Thr|Xaa'|Gly|Cys|Tyr|(SEQ ID NO:1374)|
|Cys|Cys|Glu|Tyr|Cys|Cys|Asn|Xaa'|Pro|Xaa'|Ala|Xaa'|Cys|Thr|Gly|Xaa'|Cys|Tyr|(SEQ ID NO:1375)|
|Cys|Cys|Glu|Tyr|Cys|Cys|Asn|Xaa'|Pro|Xaa'|Ala|Xaa'|Cys|Thr|Gly|Cys|Xaa'|Tyr|(SEQ ID NO:1376)|
|Cys|Cys|Glu|Tyr|Cys|Cys|Asn|Xaa'|Pro|Xaa'|Ala|Cys|Xaa'|Thr|Gly|Cys|Tyr|(SEQ ID NO:1377)|
|Cys|Cys|Glu|Tyr|Cys|Cys|Asn|Xaa'|Pro|Xaa'|Ala|Cys|Xaa'|Xaa'|Thr|Gly|Cys|Tyr|(SEQ ID NO:1378)|
|Cys|Cys|Glu|Tyr|Cys|Cys|Asn|Xaa'|Pro|Xaa'|Ala|Cys|Xaa'|Thr|Xaa'|Gly|Cys|Tyr|(SEQ ID NO:1379)|
|Cys|Cys|Glu|Tyr|Cys|Cys|Asn|Xaa'|Pro|Xaa'|Ala|Cys|Xaa'|Thr|Gly|Xaa'|Cys|Tyr|(SEQ ID NO:1380)|
|Cys|Cys|Glu|Tyr|Cys|Cys|Asn|Xaa'|Pro|Xaa'|Ala|Cys|Xaa'|Thr|Gly|Cys|Xaa'|Tyr|(SEQ ID NO:1381)|
|Cys|Cys|Glu|Tyr|Cys|Cys|Asn|Xaa'|Pro|Xaa'|Ala|Cys|Thr|Xaa'|Xaa'|Gly|Cys|Tyr|(SEQ ID NO:1382)|
|Cys|Cys|Glu|Tyr|Cys|Cys|Asn|Xaa'|Pro|Xaa'|Ala|Cys|Thr|Xaa'|Gly|Xaa'|Cys|Tyr|(SEQ ID NO:1383)|
|Cys|Cys|Glu|Tyr|Cys|Cys|Asn|Xaa'|Pro|Xaa'|Ala|Cys|Thr|Xaa'|Gly|Cys|Xaa'|Tyr|(SEQ ID NO:1384)|
|Cys|Cys|Glu|Tyr|Cys|Cys|Asn|Xaa'|Pro|Xaa'|Ala|Cys|Thr|Gly|Xaa'|Xaa'|Cys|Tyr|(SEQ ID NO:1385)|
|Cys|Cys|Glu|Tyr|Cys|Cys|Asn|Xaa'|Pro|Xaa'|Ala|Cys|Thr|Gly|Xaa'|Cys|Xaa'|Tyr|(SEQ ID NO:1386)|
|Cys|Cys|Glu|Tyr|Cys|Cys|Asn|Xaa'|Pro|Xaa'|Ala|Cys|Thr|Gly|Cys|Xaa'|Xaa'|Tyr|(SEQ ID NO:1387)|
|Cys|Cys|Glu|Tyr|Cys|Cys|Asn|Xaa'|Pro|Ala|Xaa'|Xaa'|Cys|Xaa'|Thr|Gly|Cys|Tyr|(SEQ ID NO:1388)|
|Cys|Cys|Glu|Tyr|Cys|Cys|Asn|Xaa'|Pro|Ala|Xaa'|Xaa'|Cys|Thr|Xaa'|Gly|Cys|Tyr|(SEQ ID NO:1389)|
|Cys|Cys|Glu|Tyr|Cys|Cys|Asn|Xaa'|Pro|Ala|Xaa'|Xaa'|Cys|Thr|Gly|Xaa'|Cys|Tyr|(SEQ ID NO:1390)|
|Cys|Cys|Glu|Tyr|Cys|Cys|Asn|Xaa'|Pro|Ala|Xaa'|Xaa'|Cys|Thr|Gly|Cys|Xaa'|Tyr|(SEQ ID NO:1391)|
|Cys|Cys|Glu|Tyr|Cys|Cys|Asn|Xaa'|Pro|Ala|Xaa'|Cys|Xaa'|Thr|Gly|Cys|Tyr|(SEQ ID NO:1392)|
|Cys|Cys|Glu|Tyr|Cys|Cys|Asn|Xaa'|Pro|Ala|Xaa'|Cys|Xaa'|Xaa'|Thr|Gly|Cys|Tyr|(SEQ ID NO:1393)|
|Cys|Cys|Glu|Tyr|Cys|Cys|Asn|Xaa'|Pro|Ala|Xaa'|Cys|Xaa'|Thr|Xaa'|Gly|Cys|Tyr|(SEQ ID NO:1394)|
|Cys|Cys|Glu|Tyr|Cys|Cys|Asn|Xaa'|Pro|Ala|Xaa'|Cys|Xaa'|Thr|Gly|Xaa'|Cys|Tyr|(SEQ ID NO:1395)|
|Cys|Cys|Glu|Tyr|Cys|Cys|Asn|Xaa'|Pro|Ala|Xaa'|Cys|Xaa'|Thr|Gly|Cys|Xaa'|Tyr|(SEQ ID NO:1396)|

FIG. 12-37

| | | | | | | | | | | | |
|---|---|---|---|---|---|---|---|---|---|---|---|
| Cys Cys Glu Tyr Cys Asn Xaa' Pro Ala Xaa' Xaa' Cys Thr Gly Cys Xaa' Tyr | (SEQ ID NO:1397) |
| Cys Cys Glu Tyr Cys Asn Xaa' Pro Ala Xaa' Xaa' Cys Xaa' Thr Gly Cys Tyr | (SEQ ID NO:1398) |
| Cys Cys Glu Tyr Cys Asn Xaa' Pro Ala Xaa' Cys Xaa' Xaa' Thr Gly Cys Tyr | (SEQ ID NO:1399) |
| Cys Cys Glu Tyr Cys Asn Xaa' Pro Ala Xaa' Cys Xaa' Thr Xaa' Gly Cys Tyr | (SEQ ID NO:1400) |
| Cys Cys Glu Tyr Cys Asn Xaa' Pro Ala Xaa' Cys Xaa' Thr Gly Xaa' Cys Tyr | (SEQ ID NO:1401) |
| Cys Cys Glu Tyr Cys Asn Xaa' Pro Ala Xaa' Cys Xaa' Thr Gly Cys Xaa' Tyr | (SEQ ID NO:1402) |
| Cys Cys Glu Tyr Cys Asn Xaa' Pro Ala Xaa' Cys Xaa' Thr Gly Cys Tyr | (SEQ ID NO:1403) |
| Cys Cys Glu Tyr Cys Asn Xaa' Pro Ala Cys Xaa' Xaa' Xaa' Thr Gly Cys Tyr | (SEQ ID NO:1404) |
| Cys Cys Glu Tyr Cys Asn Xaa' Pro Ala Cys Xaa' Xaa' Thr Xaa' Gly Cys Tyr | (SEQ ID NO:1405) |
| Cys Cys Glu Tyr Cys Asn Xaa' Pro Ala Cys Xaa' Xaa' Thr Gly Xaa' Cys Tyr | (SEQ ID NO:1406) |
| Cys Cys Glu Tyr Cys Asn Xaa' Pro Ala Cys Xaa' Xaa' Thr Gly Cys Xaa' Tyr | (SEQ ID NO:1407) |
| Cys Cys Glu Tyr Cys Asn Xaa' Pro Ala Cys Xaa' Thr Xaa' Xaa' Gly Cys Tyr | (SEQ ID NO:1408) |
| Cys Cys Glu Tyr Cys Asn Xaa' Pro Ala Cys Xaa' Thr Xaa' Gly Xaa' Cys Tyr | (SEQ ID NO:1409) |
| Cys Cys Glu Tyr Cys Asn Xaa' Pro Ala Cys Xaa' Thr Xaa' Gly Cys Xaa' Tyr | (SEQ ID NO:1410) |
| Cys Cys Glu Tyr Cys Asn Xaa' Pro Ala Cys Xaa' Thr Gly Cys Xaa' Xaa' Tyr | (SEQ ID NO:1411) |
| Cys Cys Glu Tyr Cys Asn Xaa' Pro Ala Cys Xaa' Thr Gly Cys Xaa' Tyr | (SEQ ID NO:1412) |
| Cys Cys Glu Tyr Cys Asn Xaa' Pro Ala Cys Xaa' Xaa' Thr Gly Cys Tyr | (SEQ ID NO:1413) |
| Cys Cys Glu Tyr Cys Asn Xaa' Pro Ala Cys Xaa' Xaa' Xaa' Thr Gly Cys Tyr | (SEQ ID NO:1414) |
| Cys Cys Glu Tyr Cys Asn Xaa' Pro Ala Cys Xaa' Xaa' Thr Xaa' Gly Cys Tyr | (SEQ ID NO:1415) |
| Cys Cys Glu Tyr Cys Asn Xaa' Pro Ala Cys Xaa' Xaa' Thr Gly Xaa' Cys Tyr | (SEQ ID NO:1416) |
| Cys Cys Glu Tyr Cys Asn Xaa' Pro Ala Cys Xaa' Xaa' Thr Gly Cys Xaa' Tyr | (SEQ ID NO:1417) |
| Cys Cys Glu Tyr Cys Asn Xaa' Pro Ala Cys Xaa' Thr Xaa' Xaa' Gly Cys Tyr | (SEQ ID NO:1418) |
| Cys Cys Glu Tyr Cys Asn Xaa' Pro Ala Cys Xaa' Thr Xaa' Gly Xaa' Cys Tyr | (SEQ ID NO:1419) |
| Cys Cys Glu Tyr Cys Asn Xaa' Pro Ala Cys Xaa' Thr Xaa' Gly Cys Xaa' Tyr | (SEQ ID NO:1420) |
| Cys Cys Glu Tyr Cys Asn Xaa' Pro Ala Cys Xaa' Thr Gly Xaa' Xaa' Cys Tyr | (SEQ ID NO:1421) |
| Cys Cys Glu Tyr Cys Asn Xaa' Pro Ala Cys Xaa' Thr Gly Xaa' Cys Xaa' Tyr | (SEQ ID NO:1422) |
| Cys Cys Glu Tyr Cys Asn Xaa' Pro Ala Cys Xaa' Thr Gly Cys Xaa' Xaa' Tyr | (SEQ ID NO:1423) |
| Cys Cys Glu Tyr Cys Asn Xaa' Pro Ala Cys Xaa' Thr Gly Cys Xaa' Tyr | (SEQ ID NO:1424) |
| Cys Cys Glu Tyr Cys Asn Xaa' Pro Ala Cys Xaa' Thr Gly Cys Xaa' Tyr | (SEQ ID NO:1425) |

FIG. 12-38

```
Cys Cys Glu Tyr Cys Cys Asn Xaa' Pro Ala Cys Xaa' Thr Gly Cys Xaa' Xaa' Tyr   (SEQ ID NO:1426)
Cys Cys Glu Tyr Cys Cys Asn Xaa' Pro Ala Cys Thr Xaa' Gly Cys Tyr              (SEQ ID NO:1427)
Cys Cys Glu Tyr Cys Cys Asn Xaa' Pro Ala Cys Thr Xaa' Gly Cys Tyr              (SEQ ID NO:1428)
Cys Cys Glu Tyr Cys Cys Asn Xaa' Pro Ala Cys Thr Xaa' Xaa' Gly Cys Tyr         (SEQ ID NO:1429)
Cys Cys Glu Tyr Cys Cys Asn Xaa' Pro Ala Cys Thr Xaa' Xaa' Gly Xaa' Cys Tyr    (SEQ ID NO:1430)
Cys Cys Glu Tyr Cys Cys Asn Xaa' Pro Ala Cys Thr Xaa' Xaa' Gly Cys Xaa' Tyr    (SEQ ID NO:1431)
Cys Cys Glu Tyr Cys Cys Asn Xaa' Pro Ala Cys Thr Xaa' Gly Xaa' Cys Tyr         (SEQ ID NO:1432)
Cys Cys Glu Tyr Cys Cys Asn Xaa' Pro Ala Cys Thr Xaa' Xaa' Gly Xaa' Cys Tyr    (SEQ ID NO:1433)
Cys Cys Glu Tyr Cys Cys Asn Xaa' Pro Ala Cys Thr Xaa' Gly Cys Xaa' Tyr         (SEQ ID NO:1434)
Cys Cys Glu Tyr Cys Cys Asn Xaa' Pro Ala Cys Thr Xaa' Gly Cys Xaa' Tyr         (SEQ ID NO:1435)
Cys Cys Glu Tyr Cys Cys Asn Xaa' Pro Ala Cys Thr Xaa' Xaa' Gly Cys Xaa' Tyr    (SEQ ID NO:1436)
Cys Cys Glu Tyr Cys Cys Asn Xaa' Pro Ala Cys Thr Gly Xaa' Cys Tyr              (SEQ ID NO:1437)
Cys Cys Glu Tyr Cys Cys Asn Xaa' Pro Ala Cys Thr Xaa' Xaa' Xaa' Cys Tyr        (SEQ ID NO:1438)
Cys Cys Glu Tyr Cys Cys Asn Xaa' Pro Ala Cys Thr Xaa' Xaa' Gly Cys Xaa' Tyr    (SEQ ID NO:1439)
Cys Cys Glu Tyr Cys Cys Asn Xaa' Pro Ala Cys Thr Xaa' Xaa' Xaa' Cys Xaa' Tyr   (SEQ ID NO:1440)
Cys Cys Glu Tyr Cys Cys Asn Xaa' Pro Ala Cys Thr Xaa' Xaa' Cys Xaa' Tyr        (SEQ ID NO:1441)
Cys Cys Glu Tyr Cys Cys Asn Xaa' Pro Ala Cys Thr Xaa' Xaa' Xaa' Cys Xaa' Tyr   (SEQ ID NO:1442)
Cys Cys Glu Tyr Cys Cys Asn Xaa' Pro Ala Cys Thr Xaa' Gly Cys Xaa' Tyr         (SEQ ID NO:1443)
Cys Cys Glu Tyr Cys Cys Asn Xaa' Pro Ala Cys Thr Xaa' Xaa' Xaa' Xaa' Tyr       (SEQ ID NO:1444)
Cys Cys Glu Tyr Cys Cys Asn Pro Ala Cys Thr Gly Cys Tyr                        (SEQ ID NO:1445)
Cys Cys Glu Tyr Cys Cys Asn Pro Xaa' Ala Cys Thr Ala Cys Thr Gly Cys Tyr       (SEQ ID NO:1446)
Cys Cys Glu Tyr Cys Cys Asn Pro Xaa' Ala Cys Thr Ala Cys Thr Gly Cys Tyr       (SEQ ID NO:1447)
Cys Cys Glu Tyr Cys Cys Asn Pro Xaa' Xaa' Ala Cys Thr Ala Cys Thr Gly Cys Tyr  (SEQ ID NO:1448)
Cys Cys Glu Tyr Cys Cys Asn Pro Xaa' Xaa' Ala Xaa' Cys Thr Ala Cys Thr Gly Cys Tyr (SEQ ID NO:1449)
Cys Cys Glu Tyr Cys Cys Asn Pro Xaa' Xaa' Ala Cys Thr Xaa' Ala Cys Thr Gly Cys Tyr (SEQ ID NO:1450)
Cys Cys Glu Tyr Cys Cys Asn Pro Xaa' Xaa' Ala Xaa' Cys Thr Xaa' Ala Cys Thr Gly Cys Tyr (SEQ ID NO:1451)
Cys Cys Glu Tyr Cys Cys Asn Pro Xaa' Ala Xaa' Cys Thr Ala Cys Thr Gly Cys Xaa' Tyr (SEQ ID NO:1452)
Cys Cys Glu Tyr Cys Cys Asn Pro Xaa' Ala Xaa' Cys Thr Xaa' Ala Cys Thr Gly Cys Xaa' Tyr (SEQ ID NO:1453)
Cys Cys Glu Tyr Cys Cys Asn Pro Xaa' Xaa' Ala Cys Thr Xaa' Ala Cys Thr Gly Cys Xaa' Tyr (SEQ ID NO:1454)
```

| | | | | | | | | | | | |
|---|---|---|---|---|---|---|---|---|---|---|---|
| Cys | Cys | Glu | Tyr | Cys | Cys | Asn | Pro | Xaa' | Ala | Xaa' | Cys | Xaa' | Thr | Xaa' | Gly | Cys | Tyr | (SEQ ID NO:1484) |

Due to the repetitive nature of this sequence listing figure, representing as structured list:

Each row follows the pattern:
Cys Cys Glu Tyr Cys Cys Asn Pro Xaa' Ala Xaa' Cys Xaa' [variant] Xaa' [variant] Cys Tyr

- Cys Cys Glu Tyr Cys Cys Asn Pro Xaa' Ala Xaa' Cys Xaa' Thr Xaa' Gly Cys Tyr (SEQ ID NO:1484)
- Cys Cys Glu Tyr Cys Cys Asn Pro Xaa' Ala Xaa' Cys Xaa' Thr Gly Xaa' Cys Tyr (SEQ ID NO:1485)
- Cys Cys Glu Tyr Cys Cys Asn Pro Xaa' Ala Xaa' Cys Xaa' Gly Cys Xaa' Cys Tyr (SEQ ID NO:1486)
- Cys Cys Glu Tyr Cys Cys Asn Pro Xaa' Ala Xaa' Cys Thr Xaa' Gly Cys Xaa' Tyr (SEQ ID NO:1487)
- Cys Cys Glu Tyr Cys Cys Asn Pro Xaa' Ala Xaa' Cys Thr Gly Xaa' Cys Xaa' Tyr (SEQ ID NO:1488)
- Cys Cys Glu Tyr Cys Cys Asn Pro Xaa' Ala Xaa' Cys Xaa' Gly Xaa' Cys Xaa' Tyr (SEQ ID NO:1489)
- Cys Cys Glu Tyr Cys Cys Asn Pro Xaa' Ala Xaa' Cys Gly Xaa' Xaa' Cys Xaa' Tyr (SEQ ID NO:1490)
- Cys Cys Glu Tyr Cys Cys Asn Pro Xaa' Ala Xaa' Cys Xaa' Gly Xaa' Xaa' Cys Tyr (SEQ ID NO:1491)
- Cys Cys Glu Tyr Cys Cys Asn Pro Xaa' Ala Xaa' Cys Thr Gly Xaa' Xaa' Cys Tyr (SEQ ID NO:1492)
- Cys Cys Glu Tyr Cys Cys Asn Pro Xaa' Ala Xaa' Cys Xaa' Thr Xaa' Cys Xaa' Tyr (SEQ ID NO:1493)
- Cys Cys Glu Tyr Cys Cys Asn Pro Xaa' Ala Xaa' Cys Xaa' Gly Cys Xaa' Xaa' Tyr (SEQ ID NO:1494)
- Cys Cys Glu Tyr Cys Cys Asn Pro Xaa' Ala Cys Xaa' Thr Gly Cys Xaa' Xaa' Tyr (SEQ ID NO:1495)
- Cys Cys Glu Tyr Cys Cys Asn Pro Xaa' Ala Cys Xaa' Thr Gly Cys Tyr (SEQ ID NO:1496)
- Cys Cys Glu Tyr Cys Cys Asn Pro Xaa' Ala Cys Xaa' Xaa' Thr Gly Cys Tyr (SEQ ID NO:1497)
- Cys Cys Glu Tyr Cys Cys Asn Pro Xaa' Ala Cys Xaa' Xaa' Xaa' Thr Gly Cys Tyr (SEQ ID NO:1498)
- Cys Cys Glu Tyr Cys Cys Asn Pro Xaa' Ala Cys Xaa' Xaa' Thr Gly Xaa' Cys Tyr (SEQ ID NO:1499)
- Cys Cys Glu Tyr Cys Cys Asn Pro Xaa' Ala Cys Xaa' Xaa' Gly Cys Xaa' Cys Tyr (SEQ ID NO:1500)
- Cys Cys Glu Tyr Cys Cys Asn Pro Xaa' Ala Cys Xaa' Thr Xaa' Gly Cys Xaa' Tyr (SEQ ID NO:1501)
- Cys Cys Glu Tyr Cys Cys Asn Pro Xaa' Ala Cys Xaa' Xaa' Thr Gly Cys Xaa' Tyr (SEQ ID NO:1502)
- Cys Cys Glu Tyr Cys Cys Asn Pro Xaa' Ala Cys Xaa' Thr Xaa' Gly Xaa' Cys Tyr (SEQ ID NO:1503)
- Cys Cys Glu Tyr Cys Cys Asn Pro Xaa' Ala Cys Xaa' Thr Xaa' Gly Xaa' Cys Tyr (SEQ ID NO:1504)
- Cys Cys Glu Tyr Cys Cys Asn Pro Xaa' Ala Cys Xaa' Xaa' Gly Xaa' Cys Xaa' Tyr (SEQ ID NO:1505)
- Cys Cys Glu Tyr Cys Cys Asn Pro Xaa' Ala Cys Xaa' Xaa' Thr Xaa' Gly Cys Tyr (SEQ ID NO:1506)
- Cys Cys Glu Tyr Cys Cys Asn Pro Xaa' Ala Cys Xaa' Thr Xaa' Xaa' Gly Cys Tyr (SEQ ID NO:1507)
- Cys Cys Glu Tyr Cys Cys Asn Pro Xaa' Ala Cys Xaa' Xaa' Xaa' Cys Xaa' Cys Tyr (SEQ ID NO:1508)
- Cys Cys Glu Tyr Cys Cys Asn Pro Xaa' Ala Cys Thr Xaa' Gly Cys Xaa' Xaa' Tyr (SEQ ID NO:1509)
- Cys Cys Glu Tyr Cys Cys Asn Pro Xaa' Ala Cys Thr Xaa' Gly Cys Tyr (SEQ ID NO:1510)
- Cys Cys Glu Tyr Cys Cys Asn Pro Xaa' Ala Cys Xaa' Gly Cys Tyr (SEQ ID NO:1511)
- Cys Cys Glu Tyr Cys Cys Asn Pro Xaa' Ala Cys Xaa' Thr Xaa' Gly Cys Tyr (SEQ ID NO:1512)

FIG. 12-41

| | | | | | | | | | | | | |
|---|---|---|---|---|---|---|---|---|---|---|---|---|
| Cys | Cys | Glu | Tyr | Cys | Cys | Asn | Pro | Xaa' | Ala | Cys | Thr | Xaa' Xaa' Xaa' Gly Cys Tyr (SEQ ID NO:1513) |
| Cys | Cys | Glu | Tyr | Cys | Cys | Asn | Pro | Xaa' | Ala | Cys | Thr | Xaa' Xaa' Xaa' Gly Xaa' Cys Tyr (SEQ ID NO:1514) |
| Cys | Cys | Glu | Tyr | Cys | Cys | Asn | Pro | Xaa' | Ala | Cys | Thr | Xaa' Xaa' Gly Cys Xaa' Tyr (SEQ ID NO:1515) |
| Cys | Cys | Glu | Tyr | Cys | Cys | Asn | Pro | Xaa' | Ala | Cys | Thr | Xaa' Gly Xaa' Cys Tyr (SEQ ID NO:1516) |
| Cys | Cys | Glu | Tyr | Cys | Cys | Asn | Pro | Xaa' | Ala | Cys | Thr | Xaa' Gly Xaa' Xaa' Cys Tyr (SEQ ID NO:1517) |
| Cys | Cys | Glu | Tyr | Cys | Cys | Asn | Pro | Xaa' | Ala | Cys | Thr | Xaa' Gly Xaa' Cys Xaa' Tyr (SEQ ID NO:1518) |
| Cys | Cys | Glu | Tyr | Cys | Cys | Asn | Pro | Xaa' | Ala | Cys | Thr | Xaa' Gly Cys Xaa' Xaa' Tyr (SEQ ID NO:1519) |
| Cys | Cys | Glu | Tyr | Cys | Cys | Asn | Pro | Xaa' | Ala | Cys | Thr | Gly Xaa' Cys Tyr (SEQ ID NO:1520) |
| Cys | Cys | Glu | Tyr | Cys | Cys | Asn | Pro | Xaa' | Ala | Cys | Thr | Gly Xaa' Xaa' Cys Tyr (SEQ ID NO:1521) |
| Cys | Cys | Glu | Tyr | Cys | Cys | Asn | Pro | Xaa' | Ala | Cys | Thr | Gly Xaa' Xaa' Xaa' Cys Tyr (SEQ ID NO:1522) |
| Cys | Cys | Glu | Tyr | Cys | Cys | Asn | Pro | Xaa' | Ala | Cys | Thr | Gly Xaa' Xaa' Cys Xaa' Tyr (SEQ ID NO:1523) |
| Cys | Cys | Glu | Tyr | Cys | Cys | Asn | Pro | Xaa' | Ala | Cys | Thr | Gly Xaa' Cys Xaa' Tyr (SEQ ID NO:1524) |
| Cys | Cys | Glu | Tyr | Cys | Cys | Asn | Pro | Xaa' | Ala | Cys | Thr | Gly Xaa' Cys Xaa' Xaa' Tyr (SEQ ID NO:1525) |
| Cys | Cys | Glu | Tyr | Cys | Cys | Asn | Pro | Xaa' | Ala | Cys | Thr | Gly Cys Xaa' Tyr (SEQ ID NO:1526) |
| Cys | Cys | Glu | Tyr | Cys | Cys | Asn | Pro | Ala | Xaa' | Xaa' | Cys | Thr Gly Cys Tyr (SEQ ID NO:1527) |
| Cys | Cys | Glu | Tyr | Cys | Cys | Asn | Pro | Ala | Xaa' | Xaa' | Xaa' | Cys Thr Gly Cys Tyr (SEQ ID NO:1528) |
| Cys | Cys | Glu | Tyr | Cys | Cys | Asn | Pro | Ala | Xaa' | Xaa' | Xaa' | Xaa' Cys Thr Gly Cys Tyr (SEQ ID NO:1529) |
| Cys | Cys | Glu | Tyr | Cys | Cys | Asn | Pro | Ala | Xaa' | Xaa' | Xaa' | Xaa' Xaa' Cys Thr Gly Cys Tyr (SEQ ID NO:1530) |
| Cys | Cys | Glu | Tyr | Cys | Cys | Asn | Pro | Ala | Xaa' | Xaa' | Xaa' | Xaa' Cys Thr Gly Cys Tyr (SEQ ID NO:1531) |
| Cys | Cys | Glu | Tyr | Cys | Cys | Asn | Pro | Ala | Xaa' | Xaa' | Xaa' | Cys Thr Gly Cys Tyr (SEQ ID NO:1532) |
| Cys | Cys | Glu | Tyr | Cys | Cys | Asn | Pro | Ala | Xaa' | Xaa' | Xaa' | Xaa' Cys Thr Gly Cys Tyr (SEQ ID NO:1533) |
| Cys | Cys | Glu | Tyr | Cys | Cys | Asn | Pro | Ala | Xaa' | Xaa' | Xaa' | Cys Xaa' Thr Gly Cys Tyr (SEQ ID NO:1534) |
| Cys | Cys | Glu | Tyr | Cys | Cys | Asn | Pro | Ala | Xaa' | Xaa' | Xaa' | Cys Thr Xaa' Gly Cys Tyr (SEQ ID NO:1535) |
| Cys | Cys | Glu | Tyr | Cys | Cys | Asn | Pro | Ala | Xaa' | Xaa' | Xaa' | Cys Thr Gly Xaa' Cys Tyr (SEQ ID NO:1536) |
| Cys | Cys | Glu | Tyr | Cys | Cys | Asn | Pro | Ala | Xaa' | Xaa' | Xaa' | Cys Thr Gly Cys Xaa' Tyr (SEQ ID NO:1537) |
| Cys | Cys | Glu | Tyr | Cys | Cys | Asn | Pro | Ala | Xaa' | Xaa' | Cys | Xaa' Thr Gly Cys Tyr (SEQ ID NO:1538) |
| Cys | Cys | Glu | Tyr | Cys | Cys | Asn | Pro | Ala | Xaa' | Xaa' | Cys | Xaa' Xaa' Thr Gly Cys Tyr (SEQ ID NO:1539) |
| Cys | Cys | Glu | Tyr | Cys | Cys | Asn | Pro | Ala | Xaa' | Xaa' | Cys | Xaa' Thr Xaa' Gly Cys Tyr (SEQ ID NO:1540) |
| Cys | Cys | Glu | Tyr | Cys | Cys | Asn | Pro | Ala | Xaa' | Xaa' | Cys | Xaa' Thr Gly Xaa' Cys Tyr (SEQ ID NO:1541) |

| | |
|---|---|
| Cys Cys Glu Tyr Cys Cys Asn Pro Ala Xaa' Xaa' Cys Xaa' Thr Gly Cys Xaa' Tyr | (SEQ ID NO:1542) |
| Cys Cys Glu Tyr Cys Cys Asn Pro Ala Xaa' Xaa' Cys Thr Xaa' Gly Cys Tyr | (SEQ ID NO:1543) |
| Cys Cys Glu Tyr Cys Cys Asn Pro Ala Xaa' Xaa' Cys Thr Xaa' Xaa' Gly Cys Tyr | (SEQ ID NO:1544) |
| Cys Cys Glu Tyr Cys Cys Asn Pro Ala Xaa' Xaa' Cys Thr Xaa' Gly Xaa' Cys Tyr | (SEQ ID NO:1545) |
| Cys Cys Glu Tyr Cys Cys Asn Pro Ala Xaa' Xaa' Cys Thr Gly Xaa' Cys Xaa' Tyr | (SEQ ID NO:1546) |
| Cys Cys Glu Tyr Cys Cys Asn Pro Ala Xaa' Xaa' Cys Thr Gly Xaa' Cys Tyr | (SEQ ID NO:1547) |
| Cys Cys Glu Tyr Cys Cys Asn Pro Ala Xaa' Xaa' Cys Thr Gly Xaa' Xaa' Cys Tyr | (SEQ ID NO:1548) |
| Cys Cys Glu Tyr Cys Cys Asn Pro Ala Xaa' Xaa' Cys Thr Gly Cys Xaa' Tyr | (SEQ ID NO:1549) |
| Cys Cys Glu Tyr Cys Cys Asn Pro Ala Xaa' Xaa' Cys Thr Gly Cys Xaa' Xaa' Tyr | (SEQ ID NO:1550) |
| Cys Cys Glu Tyr Cys Cys Asn Pro Ala Xaa' Cys Xaa' Thr Gly Cys Tyr | (SEQ ID NO:1551) |
| Cys Cys Glu Tyr Cys Cys Asn Pro Ala Xaa' Cys Xaa' Xaa' Thr Gly Cys Tyr | (SEQ ID NO:1552) |
| Cys Cys Glu Tyr Cys Cys Asn Pro Ala Xaa' Cys Xaa' Thr Xaa' Gly Cys Tyr | (SEQ ID NO:1553) |
| Cys Cys Glu Tyr Cys Cys Asn Pro Ala Xaa' Cys Xaa' Thr Xaa' Xaa' Gly Cys Tyr | (SEQ ID NO:1554) |
| Cys Cys Glu Tyr Cys Cys Asn Pro Ala Xaa' Cys Xaa' Thr Xaa' Gly Xaa' Cys Tyr | (SEQ ID NO:1555) |
| Cys Cys Glu Tyr Cys Cys Asn Pro Ala Xaa' Cys Xaa' Thr Gly Xaa' Cys Tyr | (SEQ ID NO:1556) |
| Cys Cys Glu Tyr Cys Cys Asn Pro Ala Xaa' Cys Xaa' Thr Gly Xaa' Xaa' Cys Tyr | (SEQ ID NO:1557) |
| Cys Cys Glu Tyr Cys Cys Asn Pro Ala Xaa' Cys Xaa' Thr Gly Cys Xaa' Tyr | (SEQ ID NO:1558) |
| Cys Cys Glu Tyr Cys Cys Asn Pro Ala Xaa' Cys Xaa' Xaa' Gly Cys Tyr | (SEQ ID NO:1559) |
| Cys Cys Glu Tyr Cys Cys Asn Pro Ala Xaa' Cys Xaa' Xaa' Thr Gly Cys Tyr | (SEQ ID NO:1560) |
| Cys Cys Glu Tyr Cys Cys Asn Pro Ala Xaa' Cys Xaa' Xaa' Thr Xaa' Gly Cys Tyr | (SEQ ID NO:1561) |
| Cys Cys Glu Tyr Cys Cys Asn Pro Ala Xaa' Cys Xaa' Xaa' Thr Xaa' Xaa' Gly Cys Tyr | (SEQ ID NO:1562) |
| Cys Cys Glu Tyr Cys Cys Asn Pro Ala Xaa' Cys Xaa' Xaa' Thr Xaa' Gly Xaa' Cys Tyr | (SEQ ID NO:1563) |
| Cys Cys Glu Tyr Cys Cys Asn Pro Ala Xaa' Cys Xaa' Xaa' Thr Gly Xaa' Cys Tyr | (SEQ ID NO:1564) |
| Cys Cys Glu Tyr Cys Cys Asn Pro Ala Xaa' Cys Xaa' Xaa' Thr Gly Xaa' Xaa' Cys Tyr | (SEQ ID NO:1565) |
| Cys Cys Glu Tyr Cys Cys Asn Pro Ala Xaa' Cys Xaa' Xaa' Thr Gly Cys Xaa' Tyr | (SEQ ID NO:1566) |
| Cys Cys Glu Tyr Cys Cys Asn Pro Ala Xaa' Cys Thr Xaa' Gly Cys Tyr | (SEQ ID NO:1567) |
| Cys Cys Glu Tyr Cys Cys Asn Pro Ala Xaa' Cys Thr Xaa' Xaa' Gly Cys Tyr | (SEQ ID NO:1568) |
| Cys Cys Glu Tyr Cys Cys Asn Pro Ala Xaa' Cys Thr Xaa' Xaa' Gly Xaa' Cys Tyr | (SEQ ID NO:1569) |
| Cys Cys Glu Tyr Cys Cys Asn Pro Ala Xaa' Cys Thr Xaa' Xaa' Gly Xaa' Cys Tyr | (SEQ ID NO:1570) |

| # | Sequence | SEQ ID NO |
|---|---|---|
| 1 | Cys Cys Glu Tyr Cys Cys Asn Pro Ala Xaa' Cys Thr Xaa' Xaa' Gly Cys Xaa' Tyr | (SEQ ID NO:1571) |
| 2 | Cys Cys Glu Tyr Cys Cys Asn Pro Ala Xaa' Cys Thr Xaa' Gly Xaa' Xaa' Cys Tyr | (SEQ ID NO:1572) |
| 3 | Cys Cys Glu Tyr Cys Cys Asn Pro Ala Xaa' Cys Thr Xaa' Gly Xaa' Xaa' Cys Tyr | (SEQ ID NO:1573) |
| 4 | Cys Cys Glu Tyr Cys Cys Asn Pro Ala Xaa' Cys Thr Xaa' Gly Xaa' Xaa' Cys Tyr | (SEQ ID NO:1574) |
| 5 | Cys Cys Glu Tyr Cys Cys Asn Pro Ala Xaa' Cys Thr Xaa' Gly Xaa' Cys Xaa' Tyr | (SEQ ID NO:1575) |
| 6 | Cys Cys Glu Tyr Cys Cys Asn Pro Ala Xaa' Cys Thr Gly Xaa' Xaa' Xaa' Cys Tyr | (SEQ ID NO:1576) |
| 7 | Cys Cys Glu Tyr Cys Cys Asn Pro Ala Xaa' Cys Thr Gly Xaa' Xaa' Cys Xaa' Tyr | (SEQ ID NO:1577) |
| 8 | Cys Cys Glu Tyr Cys Cys Asn Pro Ala Xaa' Cys Thr Gly Xaa' Xaa' Xaa' Cys Tyr | (SEQ ID NO:1578) |
| 9 | Cys Cys Glu Tyr Cys Cys Asn Pro Ala Xaa' Cys Thr Gly Xaa' Xaa' Cys Xaa' Tyr | (SEQ ID NO:1579) |
| 10 | Cys Cys Glu Tyr Cys Cys Asn Pro Ala Xaa' Cys Thr Gly Xaa' Xaa' Cys Xaa' Tyr | (SEQ ID NO:1580) |
| 11 | Cys Cys Glu Tyr Cys Cys Asn Pro Ala Xaa' Cys Thr Gly Xaa' Xaa' Cys Xaa' Tyr | (SEQ ID NO:1581) |
| 12 | Cys Cys Glu Tyr Cys Cys Asn Pro Ala Xaa' Cys Thr Gly Xaa' Cys Xaa' Xaa' Tyr | (SEQ ID NO:1582) |
| 13 | Cys Cys Glu Tyr Cys Cys Asn Pro Ala Xaa' Cys Thr Gly Cys Xaa' Xaa' Xaa' Tyr | (SEQ ID NO:1583) |
| 14 | Cys Cys Glu Tyr Cys Cys Asn Pro Ala Xaa' Cys Thr Gly Cys Xaa' Xaa' Xaa' Tyr | (SEQ ID NO:1584) |
| 15 | Cys Cys Glu Tyr Cys Cys Asn Pro Ala Cys Xaa' Thr Gly Cys Xaa' Xaa' Xaa' Tyr | (SEQ ID NO:1585) |
| 16 | Cys Cys Glu Tyr Cys Cys Asn Pro Ala Cys Xaa' Thr Gly Cys Tyr | (SEQ ID NO:1586) |
| 17 | Cys Cys Glu Tyr Cys Cys Asn Pro Ala Cys Xaa' Xaa' Xaa' Thr Gly Cys Tyr | (SEQ ID NO:1587) |
| 18 | Cys Cys Glu Tyr Cys Cys Asn Pro Ala Cys Xaa' Xaa' Xaa' Xaa' Thr Gly Cys Tyr | (SEQ ID NO:1588) |
| 19 | Cys Cys Glu Tyr Cys Cys Asn Pro Ala Cys Xaa' Xaa' Xaa' Xaa' Thr Gly Cys Tyr | (SEQ ID NO:1589) |
| 20 | Cys Cys Glu Tyr Cys Cys Asn Pro Ala Cys Xaa' Xaa' Xaa' Thr Gly Xaa' Cys Tyr | (SEQ ID NO:1590) |
| 21 | Cys Cys Glu Tyr Cys Cys Asn Pro Ala Cys Xaa' Xaa' Xaa' Thr Gly Xaa' Cys Tyr | (SEQ ID NO:1591) |
| 22 | Cys Cys Glu Tyr Cys Cys Asn Pro Ala Cys Xaa' Xaa' Thr Gly Xaa' Cys Xaa' Tyr | (SEQ ID NO:1592) |
| 23 | Cys Cys Glu Tyr Cys Cys Asn Pro Ala Cys Xaa' Xaa' Thr Xaa' Gly Cys Xaa' Tyr | (SEQ ID NO:1593) |
| 24 | Cys Cys Glu Tyr Cys Cys Asn Pro Ala Cys Xaa' Xaa' Thr Xaa' Gly Xaa' Cys Tyr | (SEQ ID NO:1594) |
| 25 | Cys Cys Glu Tyr Cys Cys Asn Pro Ala Cys Xaa' Xaa' Thr Xaa' Gly Xaa' Cys Tyr | (SEQ ID NO:1595) |
| 26 | Cys Cys Glu Tyr Cys Cys Asn Pro Ala Cys Xaa' Xaa' Thr Xaa' Gly Cys Xaa' Tyr | (SEQ ID NO:1596) |
| 27 | Cys Cys Glu Tyr Cys Cys Asn Pro Ala Cys Xaa' Xaa' Xaa' Thr Gly Xaa' Cys Tyr | (SEQ ID NO:1597) |
| 28 | Cys Cys Glu Tyr Cys Cys Asn Pro Ala Cys Xaa' Xaa' Thr Gly Xaa' Xaa' Cys Tyr | (SEQ ID NO:1598) |
| 29 | Cys Cys Glu Tyr Cys Cys Asn Pro Ala Cys Xaa' Xaa' Thr Gly Xaa' Cys Xaa' Tyr | (SEQ ID NO:1599) |

```
Cys Cys Glu Tyr Cys Cys Asn Pro Ala Cys Xaa Xaa' Thr Gly Cys Xaa' Tyr       (SEQ ID NO:1600)
Cys Cys Glu Tyr Cys Cys Asn Pro Ala Cys Xaa Xaa' Thr Gly Cys Xaa' Tyr       (SEQ ID NO:1601)
Cys Cys Glu Tyr Cys Cys Asn Pro Ala Cys Xaa Xaa' Thr Xaa' Gly Cys Tyr       (SEQ ID NO:1602)
Cys Cys Glu Tyr Cys Cys Asn Pro Ala Cys Xaa Xaa' Thr Xaa' Gly Cys Tyr       (SEQ ID NO:1603)
Cys Cys Glu Tyr Cys Cys Asn Pro Ala Cys Xaa Xaa' Thr Xaa' Xaa' Gly Cys Tyr  (SEQ ID NO:1604)
Cys Cys Glu Tyr Cys Cys Asn Pro Ala Cys Xaa Xaa' Thr Xaa' Xaa' Gly Xaa' Cys Tyr (SEQ ID NO:1605)
Cys Cys Glu Tyr Cys Cys Asn Pro Ala Cys Xaa Xaa' Thr Xaa' Gly Xaa' Cys Tyr  (SEQ ID NO:1606)
Cys Cys Glu Tyr Cys Cys Asn Pro Ala Cys Xaa Xaa' Thr Xaa' Gly Xaa' Cys Tyr  (SEQ ID NO:1607)
Cys Cys Glu Tyr Cys Cys Asn Pro Ala Cys Xaa Xaa' Thr Xaa' Gly Xaa' Xaa' Cys Tyr (SEQ ID NO:1608)
Cys Cys Glu Tyr Cys Cys Asn Pro Ala Cys Xaa Xaa' Thr Xaa' Gly Xaa' Xaa' Cys Tyr (SEQ ID NO:1609)
Cys Cys Glu Tyr Cys Cys Asn Pro Ala Cys Xaa Xaa' Thr Xaa' Gly Cys Xaa' Tyr  (SEQ ID NO:1610)
Cys Cys Glu Tyr Cys Cys Asn Pro Ala Cys Xaa Xaa' Thr Xaa' Gly Cys Xaa' Tyr  (SEQ ID NO:1611)
Cys Cys Glu Tyr Cys Cys Asn Pro Ala Cys Xaa Xaa' Thr Gly Xaa' Cys Tyr       (SEQ ID NO:1612)
Cys Cys Glu Tyr Cys Cys Asn Pro Ala Cys Xaa Xaa' Thr Gly Xaa' Xaa' Cys Tyr  (SEQ ID NO:1613)
Cys Cys Glu Tyr Cys Cys Asn Pro Ala Cys Xaa Xaa' Thr Xaa' Xaa' Xaa' Cys Tyr (SEQ ID NO:1614)
Cys Cys Glu Tyr Cys Cys Asn Pro Ala Cys Xaa Xaa' Thr Xaa' Gly Cys Tyr       (SEQ ID NO:1615)
Cys Cys Glu Tyr Cys Cys Asn Pro Ala Cys Xaa Xaa' Thr Xaa' Xaa' Cys Xaa' Tyr (SEQ ID NO:1616)
Cys Cys Glu Tyr Cys Cys Asn Pro Ala Cys Xaa Xaa' Thr Xaa' Cys Xaa' Tyr      (SEQ ID NO:1617)
Cys Cys Glu Tyr Cys Cys Asn Pro Ala Cys Xaa Xaa' Thr Gly Cys Xaa' Xaa' Tyr  (SEQ ID NO:1618)
Cys Cys Glu Tyr Cys Cys Asn Pro Ala Cys Xaa Xaa' Thr Gly Cys Xaa' Xaa' Tyr  (SEQ ID NO:1619)
Cys Cys Glu Tyr Cys Cys Asn Pro Ala Cys Xaa Thr Xaa' Gly Cys Tyr            (SEQ ID NO:1620)
Cys Cys Glu Tyr Cys Cys Asn Pro Ala Cys Xaa Thr Xaa' Xaa' Gly Cys Tyr       (SEQ ID NO:1621)
Cys Cys Glu Tyr Cys Cys Asn Pro Ala Cys Thr Xaa' Xaa' Xaa' Gly Cys Tyr      (SEQ ID NO:1622)
Cys Cys Glu Tyr Cys Cys Asn Pro Ala Cys Thr Xaa' Xaa' Xaa' Gly Cys Tyr      (SEQ ID NO:1623)
Cys Cys Glu Tyr Cys Cys Asn Pro Ala Cys Thr Xaa' Xaa' Xaa' Xaa' Gly Xaa' Cys Tyr (SEQ ID NO:1624)
Cys Cys Glu Tyr Cys Cys Asn Pro Ala Cys Thr Xaa' Xaa' Xaa' Gly Xaa' Cys Tyr (SEQ ID NO:1625)
Cys Cys Glu Tyr Cys Cys Asn Pro Ala Cys Thr Xaa' Xaa' Gly Xaa' Cys Tyr      (SEQ ID NO:1626)
Cys Cys Glu Tyr Cys Cys Asn Pro Ala Cys Thr Xaa' Xaa' Gly Cys Tyr           (SEQ ID NO:1627)
Cys Cys Glu Tyr Cys Cys Asn Pro Ala Cys Thr Xaa' Xaa' Gly Xaa' Cys Tyr      (SEQ ID NO:1628)
```

```
Cys Cys Glu Tyr Cys Cys Asn Pro Ala Cys Thr Xaa' Xaa' Gly Xaa' Cys Xaa' Tyr  (SEQ ID NO:1629)
Cys Cys Glu Tyr Cys Cys Asn Pro Ala Cys Thr Xaa' Xaa' Gly Xaa' Cys Xaa' Tyr  (SEQ ID NO:1630)
Cys Cys Glu Tyr Cys Cys Asn Pro Ala Cys Thr Xaa' Xaa' Gly Cys Xaa' Xaa' Tyr  (SEQ ID NO:1631)
Cys Cys Glu Tyr Cys Cys Asn Pro Ala Cys Thr Xaa' Gly Xaa' Cys Xaa' Xaa' Tyr  (SEQ ID NO:1632)
Cys Cys Glu Tyr Cys Cys Asn Pro Ala Cys Thr Xaa' Xaa' Xaa' Gly Xaa' Cys Tyr  (SEQ ID NO:1633)
Cys Cys Glu Tyr Cys Cys Asn Pro Ala Cys Thr Xaa' Xaa' Gly Xaa' Xaa' Cys Tyr  (SEQ ID NO:1634)
Cys Cys Glu Tyr Cys Cys Asn Pro Ala Cys Thr Xaa' Xaa' Gly Xaa' Cys Xaa' Tyr  (SEQ ID NO:1635)
Cys Cys Glu Tyr Cys Cys Asn Pro Ala Cys Thr Xaa' Gly Xaa' Cys Xaa' Xaa' Tyr  (SEQ ID NO:1636)
Cys Cys Glu Tyr Cys Cys Asn Pro Ala Cys Thr Gly Cys Xaa' Xaa' Xaa' Xaa' Tyr  (SEQ ID NO:1637)
Cys Cys Glu Tyr Cys Cys Asn Pro Ala Cys Thr Xaa' Gly Cys Xaa' Xaa' Xaa' Tyr  (SEQ ID NO:1638)
Cys Cys Glu Tyr Cys Cys Asn Pro Ala Cys Thr Xaa' Gly Xaa' Xaa' Xaa' Cys Tyr  (SEQ ID NO:1639)
Cys Cys Glu Tyr Cys Cys Asn Pro Ala Cys Thr Gly Xaa' Xaa' Xaa' Xaa' Cys Tyr  (SEQ ID NO:1640)
Cys Cys Glu Tyr Cys Cys Asn Pro Ala Cys Thr Xaa' Xaa' Xaa' Gly Cys Xaa' Tyr  (SEQ ID NO:1641)
Cys Cys Glu Tyr Cys Cys Asn Pro Ala Cys Thr Xaa' Xaa' Gly Xaa' Xaa' Cys Tyr  (SEQ ID NO:1642)
Cys Cys Glu Tyr Cys Cys Asn Pro Ala Cys Thr Xaa' Xaa' Xaa' Xaa' Gly Cys Tyr  (SEQ ID NO:1643)
Cys Cys Glu Tyr Cys Cys Asn Pro Ala Cys Thr Xaa' Xaa' Gly Xaa' Xaa' Cys Tyr  (SEQ ID NO:1644)
Cys Cys Glu Tyr Cys Cys Asn Pro Ala Cys Thr Xaa' Xaa' Gly Xaa' Cys Xaa' Tyr  (SEQ ID NO:1645)
Cys Cys Glu Tyr Cys Cys Asn Pro Ala Cys Thr Xaa' Gly Xaa' Cys Xaa' Xaa' Tyr  (SEQ ID NO:1646)
Cys Cys Glu Tyr Cys Cys Asn Pro Ala Cys Thr Xaa' Xaa' Gly Xaa' Cys Xaa' Tyr  (SEQ ID NO:1647)
Cys Cys Glu Tyr Cys Cys Asn Pro Ala Cys Thr Gly Xaa' Cys Xaa' Xaa' Xaa' Tyr  (SEQ ID NO:1648)
Cys Cys Glu Tyr Cys Cys Asn Pro Ala Cys Thr Xaa' Gly Xaa' Xaa' Xaa' Cys Tyr  (SEQ ID NO:1649)
Cys Cys Glu Tyr Cys Cys Asn Pro Ala Cys Thr Gly Cys Xaa' Xaa' Xaa' Xaa' Tyr  (SEQ ID NO:1650)
Cys Cys Glu Tyr Cys Cys Asn Pro Ala Cys Thr Gly Cys Xaa' Xaa' Xaa' Xaa' Tyr  (SEQ ID NO:1651)
Cys Cys Glu Tyr Cys Cys Asn Pro Ala Cys Thr Gly Cys Xaa' Xaa' Xaa' Xaa' Tyr  (SEQ ID NO:1652)
Cys Cys Glu Tyr Cys Cys Asn Pro Ala Cys Thr Gly Xaa' Cys Xaa' Xaa' Xaa' Tyr  (SEQ ID NO:1653)
Cys Cys Glu Tyr Cys Cys Asn Pro Ala Cys Thr Gly Cys Xaa' Xaa' Xaa' Xaa' Tyr  (SEQ ID NO:1854)
```

*FIG. 12-46*

METHODS AND COMPOSITIONS FOR THE TREATMENT OF GASTROINTESTINAL DISORDERS

CLAIM OF PRIORITY

This application is a continuation in part of U.S. Utility patent application Ser. No. 10/899,806, filed Jul. 27, 2004, now U.S. Pat. No. 7,371,727 which is a continuation in part of U.S. Utility patent application Ser. No. 10/845,895, filed May 14, 2004 now abandoned, which is a continuation in part of U.S. Utility patent application Ser. No. 10/796,719, filed Mar. 9, 2004, now U.S. Pat. No. 7,304,036 which is a continuation in part of U.S. Utility patent application Ser. No. 10/766,735, filed Jan. 28, 2004, now abandoned which claims priority under 35 USC §119(e) to U.S. Provisional Patent Application Ser. No. 60/443,098, filed on Jan. 28, 2003; U.S. Provisional Patent Application Ser. No. 60/471,288, filed on May 15, 2003 and U.S. Provisional Patent Application Ser. No. 60/519,460, filed on Nov. 12, 2003, the entire contents of which are hereby incorporated by reference.

SUBMISSIONS ON COMPACT DISC

A Sequence Listing as required under 37 C.F.R. §1.821(c) is submitted on a compact disc as permitted under 37 C.F.R. §1.52(e). The data file on the compact disc has the file name 14184-057001.txt, contains 614 KB of data, and was created on Sep. 22, 2005. The contents of the compact disc are hereby incorporated by reference in their entirety.

Two duplicate copies (Copy 1 and Copy 2) of the compact disc are submitted.

TECHNICAL FIELD

This invention relates to methods and compositions for treating various disorders, including gastrointestinal disorders, obesity, congestive heart failure and benign prostatic hyperplasia.

BACKGROUND

Irritable bowel syndrome (IBS) is a common chronic disorder of the intestine that affects 20 to 60 million individuals in the US alone (Lehman Brothers, Global Healthcare-Irritable bowel syndrome industry update, September 1999). IBS is the most common disorder diagnosed by gastroenterologists (28% of patients examined) and accounts for 12% of visits to primary care physicians (Camilleri 2001, Gastroenterology 120:652-668). In the US, the economic impact of IBS is estimated at $25 billion annually, through direct costs of health care use and indirect costs of absenteeism from work (Talley 1995, Gastroenterology 109:1736-1741). Patients with IBS have three times more absenteeism from work and report a reduced quality of life. Sufferers may be unable or unwilling to attend social events, maintain employment, or travel even short distances (Drossman 1993, Dig Dis Sci 38:1569-1580). There is a tremendous unmet medical need in this population since few prescription options exist to treat IBS.

Patients with IBS suffer from abdominal pain and a disturbed bowel pattern. Three subgroups of IBS patients have been defined based on the predominant bowel habit: constipation-predominant (c-IBS), diarrhea-predominant (d-IBS) or alternating between the two (a-IBS). Estimates of individuals who suffer from c-IBS range from 20-50% of the IBS patients with 30% frequently cited. In contrast to the other two subgroups that have a similar gender ratio, c-IBS is more common in women (ratio of 3:1) (Talley et al. 1995, Am J Epidemiol 142:76-83).

The definition and diagnostic criteria for IBS have been formalized in the "Rome Criteria" (Drossman et al. 1999, Gut 45:Suppl II: 1-81), which are well accepted in clinical practice. However, the complexity of symptoms has not been explained by anatomical abnormalities or metabolic changes. This has led to the classification of IBS as a functional GI disorder, which is diagnosed on the basis of the Rome criteria and limited evaluation to exclude organic disease (Ringel et al. 2001, Annu Rev Med 52: 319-338). IBS is considered to be a "biopsychosocial" disorder resulting from a combination of three interacting mechanisms: altered bowel motility, an increased sensitivity of the intestine or colon to pain stimuli (visceral sensitivity) and psychosocial factors (Camilleri 2001, Gastroenterology 120:652-668). Recently, there has been increasing evidence for a role of inflammation in etiology of IBS. Reports indicate that subsets of IBS patients have small but significant increases in colonic inflammatory and mast cells, increased inducible nitric oxide (NO) and synthase (iNOS) and altered expression of inflammatory cytokines (reviewed by Talley 2000, Medscape Coverage of DDW week).

SUMMARY

The present invention features compositions and related methods for treating IBS and other gastrointestinal disorders and conditions (e.g., gastrointestinal motility disorders, functional gastrointestinal disorders, gastroesophageal reflux disease (GERD), duodenogastric reflux, Crohn's disease, ulcerative colitis, inflammatory bowel disease, functional heartburn, dyspepsia (including functional dyspepsia or non-ulcer dyspepsia), gastroparesis, chronic intestinal pseudo-obstruction (or colonic pseudo-obstruction)), and disorders and conditions associated with constipation, e.g., constipation associated with use of opiate pain killers, post-surgical constipation, and constipation associated with neuropathic disorders as well as other conditions and disorders. The compositions feature peptides that activate the guanylate cyclase C (GC-C) receptor.

The present invention also features compositions and related methods for treating obesity, congestive heart failure and benign prostatic hyperplasia (BPH).

Without being bound by any particular theory, in the case of IBS and other gastrointestinal disorders the peptides are useful because they may increase gastrointestinal motility.

Without being bound by any particular theory, in the case of IBS and other gastrointestinal disorders the peptides are useful, in part, because they may decrease inflammation.

Without being bound by any particular theory, in the case of IBS and other gastrointestinal disorders the peptides are also useful because they may decrease gastrointestinal pain or visceral pain.

The invention features pharmaceutical compositions comprising certain peptides that are capable of activating the guanylate-cyclase C (GC-C) receptor. Also within the invention are pharmaceutical compositions comprising a peptide or GC-C agonist of the invention and one or more additional therapeutic agents including, without limitation, the agents described herein. The other agents can be administered with the peptides of the invention (simultaneously or sequentially). They can also be linked to a peptide of the invention to create therapeutic conjugates.

The invention includes methods for treating various gastrointestinal disorders by administering a peptide that acts as a partial or complete agonist of the GC-C receptor. The peptide includes at least six cysteines that can form three disulfide bonds. In certain embodiments the disulfide bonds are replaced by other covalent cross-links and in some cases the cysteines are substituted by other residues to provide for alternative covalent cross-links. The peptides may also include at least one trypsin or chymotrypsin cleavage site and/or an amino or carboxy-terminal analgesic peptide or small molecule, e.g., AspPhe or some other analgesic peptide. When present within the peptide, the analgesic peptide or small molecule may be preceded by a chymotrypsin or trypsin cleavage site that allows release of the analgesic peptide or small molecule. The peptides and methods of the invention are also useful for treating pain and inflammation associated with various disorders, including gastrointestinal disorders. Certain peptides include a functional chymotrypsin or trypsin cleavage site located so as to allow inactivation of the peptide upon cleavage. Certain peptides having a functional cleavage site undergo cleavage and gradual inactivation in the digestive tract, and this is desirable in some circumstances. In certain peptides, a functional chymotrypsin site is altered, increasing the stability of the peptide in vivo.

The invention includes methods for treating other disorders such as congestive heart failure and benign prostatic hyperplasia by administering a peptide or small molecule (parenterally or orally) that acts as an agonist of the GC-C receptor. Such agents can be used in combination with natriuretic peptides (e.g., atrial natriuretic peptide, brain natriuretic peptide or C-type natriuretic peptide), a diuretic, or an inhibitor of angiotensin converting enzyme.

The invention features methods and compositions for increasing intestinal motility. Intestinal motility involves spontaneous coordinated dissentions and contractions of the stomach, intestines, colon and rectum to move food through the gastrointestinal tract during the digestive process.

In certain embodiments the peptides include either one or two or more contiguous negatively charged amino acids (e.g., Asp or Glu) or one or two or more contiguous positively charged residues (e.g., Lys or Arg) or one or two or more contiguous positively or negatively charged amino acids at the carboxy terminus. In these embodiments all of the flanking amino acids at the carboxy terminus are either positively or negatively charged. In other embodiments the carboxy terminal charged amino acids are preceded by a Leu. For example, the following amino acid sequences can be added to the carboxy terminus of the peptide: Asp; Asp Lys; Lys Lys Lys Lys Lys Lys (SEQ ID NO:127); Asp Lys Lys Lys Lys Lys (SEQ ID NO:128); Leu Lys Lys; and Leu Asp. It is also possible to simply add Leu at the carboxy terminus.

In a first aspect, the invention features a peptide comprising, consisting of, or consisting essentially of the amino acid sequence (I):

(SEQ ID NO: 1)
$Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $X_{aa14}$ $Cys_{15}$ $Xaa_{16}$ $Xaa_{17}$ $Cys_{18}$ $Xaa_{19}$ $Xaa_{20}$ $Xaa_{21}$

In some embodiments $Xaa_1$ $Xaa_2$ $Xaa_3$ $Xaa_4$ $Xaa_5$ is Asn Ser Ser Asn Tyr (SEQ ID NO:126) or is missing or $Xaa_1$ $Xaa_2$ $Xaa_3$ $Xaa_4$ is missing.

In certain embodiments $Xaa_8$, $Xaa_9$, $Xaa_{12}$, $Xaa_{14}$, $Xaa_{16}$, $Xaa_{17}$, and $Xaa_{19}$ can be any amino acid. In certain embodiments $Xaa_8$, $Xaa_9$, $Xaa_{12}$, $Xaa_{14}$, $Xaa_{16}$, $Xaa_{17}$, and $Xaa_{19}$ can be any natural or non-natural amino acid or amino acid analog.

In certain embodiments $Xaa_5$ is Asn, Trp, Tyr, Asp, or Phe. In other embodiments, $Xaa_5$ can also be Thr or Ile. In other embodiments $Xaa_5$ is Tyr, Asp or Trp. In certain embodiments $Xaa_5$ is Asn, Trp, Tyr, Asp, Ile, Thr or Phe. In certain embodiments $Xaa_5$ is Asn.

In some embodiments $Xaa_8$ is Glu, Asp, Gln, Gly or Pro. In other embodiments $Xaa_8$ is Glu. In other embodiments $Xaa_8$ is Glu or Asp. In others it is Asn, Glu, or Asp. In others it is Glu, His, Lys, Gln, Asn, or Asp. In others it is Glu, His, Gln, Asn, or Asp. In others it is Glu, Asn, His, Gln, Lys, Asp or Ser. In still others it is Pro. In certain embodiments it is any natural or non-natural amino acid or amino acid analog.

In some embodiments $Xaa_9$ is Leu, Ile, Val, Ala, Lys, Arg, Trp, Tyr or Phe. In some embodiments $Xaa_9$ is Leu, Ile, Val, Lys, Arg, Trp, Tyr or Phe. In others it is Leu, Ile, Val, Trp, Tyr or Phe. In others it is Leu, Ile or Val. In others it is Trp, Tyr or Phe. In others it is Leu, Ile, Lys, Arg, Trp, Tyr, or Phe. In others it is Leu, Val, Ile, or Met. In others it is Leu or Phe. In others it is Leu, Phe, or Tyr. In others it is Tyr, Phe or His. In others it is Phe, His, Trp, or Tyr. In certain embodiments, $Xaa_9$ is not Leu. In others it is Tyr. In other embodiments it is any natural or non-natural aromatic amino acid or amino acid analog. In certain embodiments it is any natural or non-natural amino acid or amino acid analog.

In certain embodiments, $Xaa_2$ is Asn, Tyr, Asp or Ala. In others it is Asn. In others it is Asn, Met, Arg, Lys, His, or Gln. In others it is Asn, Lys, His, or Gln. In others it is Asn, Asp, Glu or Gln. In others it is Asn, Thr, Ser, Arg, Lys, Gln, or His. In others it is Asn, Ser, or His. In certain embodiments it is any natural or non-natural amino acid or amino acid analog.

In certain embodiments, $Xaa_{13}$ is Ala, Pro or Gly. In others it is Pro or Gly. In others it is Pro and in still others it is Gly.

In certain embodiments, $Xaa_{14}$ is Ala, Leu, Ser, Gly, Val, Glu, Gln, Ile, Leu, Thr, Lys, Arg, or Asp. In others it is Ala or Gly. In others it is Val or Ala. In others it is Ala or Thr. In others it is Ala. In others it is Val, Gln, Asn, Glu, Asp, Thr, or Ala. In others it is Gly, Cys or Ser. In still others it is Thr. In certain embodiments it is any natural or non-natural amino acid or amino acid analog.

In certain embodiments $Xaa_{16}$ is Thr, Ala, Asn, Lys, Arg, Trp, Gly or Val. In others it is Thr, Ala, Asn, Lys, Arg or Trp. In others it is Thr, Ala, Lys, Arg or Trp. In certain embodiments it is Thr, Ala or Trp. In others it is Thr. In certain embodiments it is Trp, Tyr or Phe. In certain embodiments it is Thr or Ala. In certain embodiments it is Val. In certain embodiments it is Gly. In others it is Thr, Ser, Met or Val. In others it is Val, Ala, or Thr. In others it is Ile, Val, Lys, Asn, Glu, Asp, or Thr. In certain embodiments it is any natural or non-natural amino acid or amino acid analog. In certain embodiments it is any natural or non-natural non-aromatic amino acid or amino acid analog.

In certain embodiments $Xaa_{17}$ is Gly, Pro or Ala. In certain embodiments it is Gly. In certain embodiments it is Ala. In others it is Gly or Ala. In others it is Gly, Asn, Ser or Ala. In others it is Asn, Glu, Asp, Thr, Ala, Ser, or Gly. In others it is Asp, Ala, Ser, or Gly. In certain embodiments it is any natural or non-natural amino acid or amino acid analog.

In certain embodiments $Xaa_{19}$ is Trp, Tyr, Phe, Asn, Ile, Val, His, Leu, or Arg. In certain embodiments it is Trp, Tyr, Asn or Leu. In certain embodiments it is Trp, Tyr or Phe. In others it is Tyr, Phe or His. In others it is Tyr or Trp. In others it is Tyr. In certain embodiments it is Leu, Ile or Val. In certain embodiments it is His. In certain embodiments it is Trp, Tyr, Phe, Asn, Ile, Val, His or Leu. In certain embodiments it is Trp, Tyr, Phe or Leu. In certain embodiments it is Tyr or Leu. In certain embodiments it is Lys or Arg. In certain embodiments it is any amino acid other than Pro, Arg, Lys, Asp or Glu. In certain embodiments it is any amino acid other than Pro. In certain embodiments it is any natural or non-natural amino acid or amino acid analog. In certain embodiments it is missing.

In certain embodiments $Xaa_{20}$ is Asp or Asn. In certain embodiments $Xaa_{20}$ $Xaa_{21}$ is AspPhe or is missing or $Xaa_{20}$ is Asn or Glu and $Xaa_{21}$ is missing or $Xaa_{19}$ $Xaa_{20}$ $Xaa_{21}$ is missing.

In certain embodiments, the invention features, a purified polypeptide comprising the amino acid sequence (II):

(SEQ ID NO: 129)
$Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ wherein $Xaa_1$ $Xaa_2$ $Xaa_3$ $Xaa_4$ $Xaa_5$ is Asn Ser Ser Asn Tyr (SEQ ID NO:126) or is missing or $Xaa_1$ $Xaa_2$ $Xaa_3$ $Xaa_4$ is missing and $Xaa_5$ is Asn;

$Xaa_8$ is Glu or Asp;
$Xaa_9$ is Leu, Ile, Val, Trp, Tyr or Phe;
$Xaa_{16}$ is Thr, Ala, Trp;
$Xaa_{19}$ is Trp, Tyr, Phe or Leu or is missing; and $Xaa_{20}$ $Xaa_{21}$ is AspPhe In various embodiments the invention features a purified polypeptide comprising the amino acid sequence (II): $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ wherein, $Xaa_8$ is Leu, Ile or Val and $Xaa_{16}$ is Trp, Tyr or Phe; $Xaa_9$ is Trp, Tyr or Phe, and $Xaa_{16}$ is Thr or Ala; $Xaa_{19}$ is Trp, Tyr, Phe and $Xaa_{20}$ $Xaa_{21}$ is AspPhe; and $Xaa_1$ $Xaa_2$ $Xaa_3$ $Xaa_4$ is missing and $Xaa_5$ is Asn; the peptide comprises fewer than 50, 40, 30 or 25 amino acids; or fewer than five amino acids precede $Cys_6$.

In certain embodiments the peptide includes a peptide comprising or consisting of the amino acid sequence $Xaa_1$ $Xaa_2$ $Xaa_3$ $Xaa_4$ $Xaa_5$ Cys Cys Glu $Xaa_9$ Cys Cys Asn Pro Ala Cys Thr Gly Cys Tyr $Xaa_{20}$ $Xaa_{21}$ (II) (SEQ ID NO:2) wherein $Xaa_9$ is any amino acid: wherein $Xaa_9$ is any amino acid other than Leu; wherein $Xaa_9$ is selected from Phe, Trp and Tyr; wherein $Xaa_9$ is selected from any other natural or non-natural aromatic amino acid; wherein $Xaa_9$ is Tyr; wherein $Xaa_9$ is Phe; wherein $Xaa_9$ is Trp; wherein $Xaa_1$ $Xaa_2$ $Xaa_3$ $Xaa_4$ $Xaa_5$ is Asn Ser Ser Asn Tyr; wherein $Xaa_1$, $Xaa_2$, $Xaa_3$, $Xaa_4$, and $Xaa_5$ are missing; wherein $Xaa_1$, $Xaa_2$, $Xaa_3$ and $Xaa_4$ are missing; wherein $Xaa_1$, $Xaa_2$ and $Xaa_3$ are missing; wherein $Xaa_1$ and $Xaa_2$ are missing; wherein $Xaa_1$ is missing; wherein $Xaa_{20}$ $Xaa_{21}$ is AspPhe or is missing or $Xaa_{20}$ is Asn or Glu and $Xaa_{21}$ is missing or $Xaa_{19}$ $Xaa_{20}$ $Xaa_{21}$ is missing; wherein $Xaa_1$ $Xaa_2$ $Xaa_3$ $Xaa_4$ $Xaa_5$ and Tyr $Xaa_{20}$ $Xaa_{21}$ are missing. In the case of a peptide comprising the sequence (I): $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ wherein: $Xaa_1$ $Xaa_2$ $Xaa_3$ $Xaa_4$ $Xaa_5$ is missing and/or the sequence $Xaa_{19}$ $Xaa_{20}$ $Xaa_{21}$ is missing, the peptide can still contain additional carboxyterminal or amino terminal amino acids or both. In the case of peptides missing one or more terminal amino acids such as $Xaa_1$ or $Xaa_{21}$, the peptide can still contain additional carboxyterminal or amino terminal amino acids or both.

In certain embodiments, the peptide includes disulfide bonds between $Cys_6$ and $Cys_{11}$, between $Cys_7$ and $Cys_{15}$ and between $Cys_{10}$ and $Cys_{16}$. In other embodiments, the peptide is a reduced peptide having no disulfide bonds. In still other embodiments the peptide has one or two disulfide bonds chosen from: a disulfide bond between $Cys_6$ and $Cys_{11}$, a disulfide bond between $Cys_7$ and $Cys_{15}$ and a disulfide bond between $Cys_{10}$ and $Cys_{16}$.

In certain embodiments, one or more amino acids can be replaced by a non-naturally occurring amino acid or a naturally or non-naturally occurring amino acid analog. There are many amino acids beyond the standard 20. Some are naturally-occurring others are not (see, for example, Hunt, The Non-Protein Amino Acids: In Chemistry and Biochemistry of the Amino Acids, Barrett, Chapman and Hall, 1985). For example, an aromatic amino acid can be replaced by 3,4-dihydroxy-L-phenylalanine, 3-iodo-L-tyrosine, triiodothyronine, L-thyroxine, phenylglycine (Phg) or nor-tyrosine (norTyr). Phg and norTyr and other amino acids including Phe and Tyr can be substituted by, e.g., a halogen, —$CH_3$, —OH, —$CH_2NH_3$, —C(O)H, —$CH_2CH_3$, —CN, —$CH_2CH_2CH_3$, —SH, or another group. Any amino acid can be substituted by the D-form of the amino acid.

With regard to non-naturally occurring amino acids or a naturally and non-naturally occurring amino acid analogs, a number of substitutions in the peptide of formula I or the peptide of formula II are possible alone or in combination.

$Xaa_8$ can be replaced by gamma-Hydroxy-Glu or gamma-Carboxy-Glu.

$Xaa_9$ can be replaced by an alpha substituted amino acid such as L-alpha-methylphenylalanine or by analogues such as: 3-Amino-Tyr; Tyr($CH_3$); Tyr($PO_3(CH_3)_2$); Tyr($SO_3H$); beta-Cyclohexyl-Ala; beta-(1-Cyclopentenyl)-Ala; beta-Cyclopentyl-Ala; beta-Cyclopropyl-Ala; beta-Quinolyl-Ala; beta-(2-Thiazolyl)-Ala; beta-(Triazole-1-yl)-Ala; beta-(2-Pyridyl)-Ala; beta-(3-Pyridyl)-Ala; Amino-Phe; Fluoro-Phe; Cyclohexyl-Gly; tBu-Gly; beta-(3-benzothienyl)-Ala; beta-(2-thienyl)-Ala; 5-Methyl-Trp; and 4-Methyl-Trp.

$Xaa_{13}$ can be an N(alpha)-C(alpha) cyclized amino acid analogues with the structure:

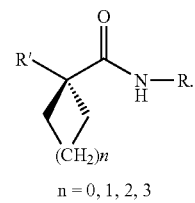

$n = 0, 1, 2, 3$ $Xaa_{13}$ can also be homopro (L-pipecolic acid); hydroxy-Pro; 3,4-Dehydro-Pro; 4-fluoro-Pro; or alpha-methyl-Pro.

When $Xaa_{13}$ is Gly, Ala, Leu or Val, $Xaa_{14}$ can be:

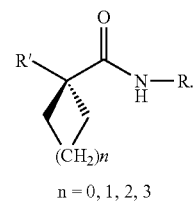

$n = 0, 1, 2, 3$ $Xaa_{14}$ can also be an alpha-substituted or N-methylated amino acid such as alpha-amino isobutyric acid (aib), L/D- alpha-ethylalanine (L/D-isovaline), L/D-methylvaline, or L/D-alpha-methylleucine or a non-natural amino acid such as beta-fluoro-Ala.

$Xaa_{17}$ can be alpha-amino isobutyric acid (aib) or L/D-alpha-ethylalanine (L/D-isovaline).

Further examples of unnatural amino acids include: an unnatural analogue of tyrosine; an unnatural analogue of glutamine; an unnatural analogue of phenylalanine; an unnatural analogue of serine; an unnatural analogue of threonine; an alkyl, aryl, acyl, azido, cyano, halo, hydrazine, hydrazide, hydroxyl, alkenyl, alkynl, ether, thiol, sulfonyl, seleno, ester, thioacid, borate, boronate, phospho, phosphono, phosphine, heterocyclic, enone, imine, aldehyde, hydroxylamine, keto, or amino substituted amino acid, or any combination thereof; an amino acid with a photoactivatable cross-linker; a spin-labeled amino acid; a fluorescent amino acid; an amino acid with a novel functional group; an amino acid that covalently or noncovalently interacts with another molecule; a metal binding amino acid; a metal-containing amino acid; a radioactive amino acid; a photocaged and/or photoisomerizable amino acid; a biotin or biotin-analogue containing amino acid; a glycosylated or carbohydrate modified amino acid; a keto containing amino acid; amino acids comprising polyethylene glycol or polyether; a heavy atom substituted amino acid (e.g., an amino acid containing deuterium, tritium, $^{13}C$, $^{15}N$, or $^{18}O$); a chemically cleavable or photocleavable amino acid; an amino acid with an elongated side chain; an amino acid containing a toxic group; a sugar substituted amino acid, e.g., a sugar substituted serine or the like; a carbon-linked sugar-containing amino acid; a redox-active amino acid; an α.-hydroxy containing acid; an amino thio acid containing amino acid; an α, α disubstituted amino acid; a β-amino acid; a cyclic amino acid other than proline; an O-methyl-L-tyrosine; an L-3-(2-naphthyl)alanine; a 3-methyl-phenylalanine; a p-acetyl-L-phenylalanine; an 0-4-allyl-L-tyrosine; a 4-propyl-L-tyrosine; a tri-O-acetyl-GlcNAcβ-serine; an L-Dopa; a fluorinated phenylalanine; an isopropyl-L-phenylalanine; a p-azido-L-phenylalanine; a p-acyl-L-phenylalanine; a p-benzoyl-L-phenylalanine; an L-phosphoserine; a phosphonoserine; a phosphonotyrosine; a p-iodo-phenylalanine; a 4-fluorophenylglycine; a p-bromophenylalanine; a p-amino-L-phenylalanine; an isopropyl-L-phenylalanine; L-3-(2-naphthyl)alanine; an amino-, isopropyl-, or O-allyl-containing phenylalanine analogue; a dopa, O-methyl-L-tyrosine; a glycosylated amino acid; a p-(propargyloxy)phenylalanine; dimethyl-Lysine; hydroxyproline; mercaptopropionic acid; methyl-lysine; 3-nitro-tyrosine; norleucine; pyro-glutamic acid; Z (Carbobenzoxyl); ε-Acetyl-Lysine; β-alanine; aminobenzoyl derivative; aminobutyric acid (Abu); citrulline; aminohexanoic acid; aminoisobutyric acid; cyclohexylalanine; d-cyclohexylalanine; hydroxyproline; nitro-arginine; nitro-phenylalanine; nitro-tyrosine; norvaline; octahydroindole carboxylate; ornithine; penicillamine; tetrahydroisoquinoline; acetamidomethyl protected amino acids and pegylated amino acids. Further examples of unnatural amino acids and amino acid analogs can be found in U.S. 20030108885, U.S. 20030082575, and the references cited therein.

In some embodiments, an amino acid can be replaced by a naturally-occurring, non-essential amino acid, e.g., taurine.

Methods to manufacture peptides containing unnatural amino acids can be found in, for example, U.S. 20030108885, U.S. 20030082575, Deiters et al., J Am Chem Soc. (2003) 125:11782-3, Chin et al., Science (2003) 301:964-7, and the references cited therein.

Peptides that include non-natural amino acids can also be prepared using the methods described in WO02086075

The peptides of the invention can have one or more conventional peptide bonds replaced by an alternative bond. Such replacements can increase the stability of the peptide. For example, replacement of the peptide bond between $Cys_{18}$ and $Xaa_{19}$ with an alternative bond can reduce cleavage by carboxy peptidases and may increase half-life in the digestive tract. Bonds that can replace peptide bonds include: a retro-inverso bonds (C(O)—NH instead of NH—C(O)); a reduced amide bond (NH—$CH_2$); a thiomethylene bond (S—$CH_2$ or $CH_2$—S); an oxomethylene bond (O—$CH_2$ or $CH_2$—O); an ethylene bond ($CH_2$—$CH_2$); a thioamide bond (C(S)—NH); a trans-olefine bond (CH═CH); an fluoro substituted trans-olefine bond (CF═CH); a ketomethylene bond (C(O)—CHR or CHR—C(O) wherein R is H or $CH_3$; and a fluoro-ketomethylene bond (C(O)—CFR or CFR—C(O) wherein R is H or F or $CH_3$.

The peptides of the invention can be modified using standard modifications. Modifications may occur at the amino (N—), carboxy (C—) terminus, internally or a combination of any of the preceeding. In one aspect of the invention, there may be more than one type of modification of the peptide. Modifications include but are not limited to: acetylation, amidation, biotinylation, cinnamoylation, farnesylation, formylation, myristoylation, palmitoylation, phosphorylation (Ser, Tyr or Thr), stearoylation, succinylation, sulfurylation and cyclisation (via disulfide bridges or amide cyclisation), and modification by Cy3 or Cy5. The peptides of the invention may also be modified by 2,4-dinitrophenyl (DNP), DNP-lysin, modification by 7-Amino-4-methyl-coumarin (AMC), flourescein, NBD (7-Nitrobenz-2-Oxa-1,3-Diazole), p-nitro-anilide, rhodamine B, EDANS (5-((2-aminoethyl)amino) naphthalene-1-sulfonic acid), dabcyl, dabsyl, dansyl, texas red, FMOC, and Tamra (Tetramethylrhodamine). The peptides of the invention may also be conjugated to, for example, polyethylene glycol (PEG); alkyl groups (e.g., C1-C20 straight or branched alkyl groups); fatty acid radicals; combinations of PEG, alkyl groups and fatty acid radicals (see U.S. Pat. No. 6,309,633; Soltero et al., 2001 Innovations in Pharmaceutical Technology 106-110); BSA and KLH (Keyhole Limpet Hemocyanin).

The peptides and agonists of the invention can be chemically modified to increase therapeutic activity by synthetically adding sugar moieties (WO 88/02756; WO 89/09786; DE 3910667 A1, EP 0 374 089 A2; and U.S. Pat. No. 4,861, 755), adding cationic anchors (EP0363589), lipid moieties (WO91/09837; U.S. Pat. No. 4,837,303) or the substituents described as compounds I, II, and III in U.S. Pat. No. 5,552, 520.

When $Xaa_9$ is Trp, Tyr or Phe or when $Xaa_{16}$ is Trp the peptide has a potentially functional chymotrypsin cleavage site that is located at a position where cleavage may alter GC-C receptor binding by the peptide. When $Xaa_9$ is Lys or Arg or when $Xaa_{16}$ is Lys or Arg, the peptide has a potentially functional trypsin cleavage site that is located at a position where cleavage may alter GC-C receptor binding by the peptide.

When $Xaa_{19}$ is Trp, Tyr or Phe, the peptide has a chymotrypsin cleavage site that is located at a position where cleavage will liberate the portion of the peptide carboxy-terminal to $Xaa_{19}$. When $Xaa_{19}$ is Leu, Ile or Val, the peptide can have a chymotrypsin cleavage site that is located at a position where cleavage will liberate the portion of the peptide amino-terminal to $Xaa_{19}$. At relatively high pH the same effect is seen when $Xaa_{19}$ is His. When $Xaa_{19}$ is Lys or Arg, the peptide has a trypsin cleavage site that is located at a position where cleavage will liberate portion of the peptide carboxy-terminal to $Xaa_{19}$. Thus, if the peptide includes an analgesic peptide carboxy-terminal to $Xaa_{19}$, the peptide will be liberated in the digestive tract upon exposure to the appropriate protease. Among the analgesic peptides which can be included in the peptide and/or coadministered with the peptide are: AspPhe (as $Xaa_{20}Xaa_{21}$), endomorphin-1, endomorphin-2, nocistatin, dalargin, lupron, ziconotide, and substance P and other analgesic peptides described herein. These peptides can, for example, be used to replace $Xaa_{20}Xaa_{21}$.

When $Xaa_1$ or the amino-terminal amino acid of the peptide of the invention (e.g., $Xaa_2$ or $Xaa_3$) is Trp, Tyr or Phe, the peptide has a chymotrypsin cleavage site that is located at a position where cleavage will liberate the portion of the peptide amino-terminal to $Xaa_1$ (or $Xaa_2$ or $Xaa_3$) along with $Xaa_1$, $Xaa_2$ or $Xaa_3$. When $Xaa_1$ or the amino-terminal amino acid of the peptide of the invention (e.g., $Xaa_2$ or $Xaa_3$) is Lys or Arg, the peptide has a trypsin cleavage site that is located at a position where cleavage will liberate portion of the peptide amino-terminal to $Xaa_1$ along with $Xaa_1$, $Xaa_2$ or $Xaa_3$). When $Xaa_1$ or the amino-terminal amino acid of the peptide of the invention is Leu, Ile or Val, the peptide can have a chymotrypsin cleavage site that is located at a position where cleavage will liberate the portion of the peptide amino-terminal to $Xaa_1$. At relatively high pH the same effect is seen when $Xaa_1$ is His. Thus, for example, if the peptide includes an analgesic peptide amino-terminal to $Xaa_1$, the peptide will be liberated in the digestive tract upon exposure to the appropriate protease. Among the analgesic peptides which can be included in the peptide are: AspPhe, endomorphin-1, endomorphin-2, nocistatin, dalargin, lupron, and substance p and other analgesic peptides described herein.

When fully folded, disulfide bonds may be present between: $Cys_6$ and $Cys_{11}$; $Cys_7$ and $Cys_{15}$; and $Cys_{10}$ and $Cys_{18}$. The peptides of the invention bear some sequence similarity to ST peptides. However, they include amino acid changes and/or additions that improve functionality. These changes can, for example, increase or decrease activity (e.g., increase or decrease the ability of the peptide to stimulate intestinal motility), alter the ability of the peptide to fold correctly, alter the stability of the peptide, alter the ability of the peptide to bind the GC-C receptor and/or decrease toxicity. In some cases the peptides may function more desirably than wild-type ST peptide. For example, they may limit undesirable side effects such as diarrhea and dehydration.

In some embodiments one or both members of one or more pairs of Cys residues which normally form a disulfide bond can be replaced by homocysteine, penicillamine, 3-mercaptoproline (Kolodziej et al. 1996 Int J Pept Protein Res 48:274); β,β dimethylcysteine (Hunt et al. 1993 Int J Pept Protein Res 42:249) or diaminopropionic acid (Smith et al. 1978 J Med Chem 21:117) to form alternative internal cross-links at the positions of the normal disulfide bonds.

In addition, one or more disulfide bonds can be replaced by alternative covalent cross-links, e.g., an amide linkage ($—CH_2CH(O)NHCH_2—$ or $—CH_2NHCH(O)CH_2—$), an ester linkage, a thioester linkage, a lactam bridge, a carbamoyl linkage, a urea linkage, a thiourea linkage, a phosphonate ester linkage, an alkyl linkage ($—CH_2CH_2CH_2CH_2—$), an alkenyl linkage ($—CH_2CH=CHCH_2—$), an ether linkage ($—CH_2CH_2OCH_2—$ or $—CH_2OCH_2CH_2—$), a thioether linkage ($—CH_2CH_2SCH_2—$ or $—CH_2SCH_2CH_2—$), an amine linkage ($—CH_2CH_2NHCH_2—$ or $—CH_2NHCH_2CH_2—$) or a thioamide linkage ($—CH_2CH(S)HNHCH_2—$ or $—CH_2NHCH(S)CH_2—$). For example, Ledu et al. (Proc Nat'l Acad. Sci. 100:11263-78, 2003) describe methods for preparing lactam and amide cross-links. Schafmeister et al. (J. Am. Chem. Soc. 122:5891, 2000) describes stable, hydrocarbon cross-links. Hydrocarbon cross links can be produced via metathesis (or methathesis followed by hydrogenation in the case of saturated hydrocarbons cross-links) using one or another of the Grubbs catalysts (available from Materia, Inc. and Sigma-Aldrich and described, for example, in U.S. Pat. Nos. 5,831,108 and 6,111,121). In some cases, the generation of such alternative cross-links requires replacing the Cys residues with other residues such as Lys or Glu or non-naturally occurring amino acids. In addition the lactam, amide and hydrocarbon cross-links can be used to stabilize the peptide even if they link amino acids at positions other than those occupied by Cys. Such cross-links can occur between two amino acids that are separated by two amino acids or between two amino acids that are separated by six amino acids (see, e.g., Schafmeister et al. (J. Am. Chem. Soc. 122:5891, 2000)).

In the case of a peptide comprising the sequence (I): $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ or $Xaa_1$ $Xaa_2$ $Xaa_3$ $Xaa_4$ $Xaa_5$ Cys Cys Glu $Xaa_9$ Cys Cys Asn Pro Ala Cys Thr Gly Cys Tyr $Xaa_{20}$ $Xaa_{21}$ (II) wherein: $Xaa_1$ $Xaa_2$ $Xaa_3$ $Xaa_4$ $Xaa_5$ is missing and/or the sequence $Xaa_{19}$ $Xaa_{20}$ $Xaa_{21}$ is missing, the peptide can still contain additional carboxyterminal or amino terminal amino acids or both. For example, the peptide can include an amino terminal sequence that facilitates recombinant production of the peptide and is cleaved prior to administration of the peptide to a patient. The peptide can also include other amino terminal or carboxyterminal amino acids. In some cases the additional amino acids protect the peptide, stabilize the peptide or alter the activity of the peptide. In some cases some or all of these additional amino acids are removed prior to administration of the peptide to a patient. The peptide can include 1, 2, 3, 4, 5, 10, 15, 20, 25, 30, 40, 50, 60, 70 80, 90, 100 or more amino acids at its amino terminus or carboxy terminus or both. The number of flanking amino acids need not be the same. For example, there can be 10 additional amino acids at the amino terminus of the peptide and none at the carboxy terminus.

In one embodiment the peptide comprises the amino acid sequence (I): $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ wherein: $Xaa_1$ $Xaa_2$ $Xaa_3$ $Xaa_4$ $Xaa_5$ is missing; $Xaa_8$ is Glu; $Xaa_9$ is Leu, Ile, Lys, Arg, Trp, Tyr or Phe; $Xaa_{12}$ is Asn; $Xaa_{13}$ is Pro; $Xaa_{14}$ is Ala; $Xaa_{16}$ is Thr, Ala, Lys, Arg, Trp; $Xaa_{17}$ is Gly; $Xaa_{19}$ is Tyr or Leu; and $Xaa_{20}$ $Xaa_{21}$ is AspPhe or is missing. Where $Xaa_{20}$ $Xaa_{21}$ and/or $Xaa_1$ $Xaa_2$ $Xaa_3$ $Xaa_4$ $Xaa_5$ are missing, there may be additional flanking amino acids in some embodiments. In certain embodiments of a composition comprising a peptide having the sequence (I): $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$, the peptide does not comprise or consist of any of the peptides of Table I.

In a second aspect, the invention also features a therapeutic or prophylactic method comprising administering to a patient a pharmaceutical composition comprising or consisting essentially of a purified peptide comprising, consisting of or consisting essentially of the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ (II) as described herein.

The peptides can be co-administered with or linked, e.g., covalently linked to any of a variety of other peptides or compounds including analgesic peptides or analgesic compounds including, without limitation, the agents described herein.

Amino acid, non-amino acid, peptide and non-peptide spacers can be interposed between a peptide that is a GC-C receptor agonist and a peptide that has some other biological function, e.g., an analgesic peptide or a peptide used to treat obesity. The linker can be one that is cleaved from the flanking peptides in vivo or one that remains linked to the flanking peptides in vivo. For example, glycine, beta-alanine, glycyl-glycine, glycyl-beta-alanine, gamma-aminobutyric acid, 6-aminocaproic acid, L-phenylalanine, L-tryptophan and glycil-L-valil-L-phenylalanine can be used as spacers (Chaltin et al. 2003 Helvetica Chimica Acta 86:533-547; Caliceti et al. 1993 FARMCO 48:919-32) as can polyethylene glycols (Butterworth et al. 1987 J. Med. Chem. 30:1295-302) and maleimide derivatives (King et al. 2002 Tetrahedron Lett. 43:1987-1990). Various other linkers are described in the literature (Nestler 1996 Molecular Diversity 2:35-42; Finn et al. 1984 Biochemistry 23:2554-8; Cook et al. 1994 Tetrahedron Lett. 35:6777-80; Brokx et al. 2002 Journal of Controlled Release 78:115-123; Griffin et al. 2003 J. Am. Chem. Soc. 125:6517-6531; Robinson et al. 1998 Proc. Natl. Acad. Sci. USA 95:5929-5934).

The peptides of the invention can be attached to one, two or more different moieties each providing the same or different functions. For example, the peptide can be linked to a molecule that is an analgesic and to a peptide that is used to treat obesity. The peptide and various moieties can be ordered in various ways. For example, a peptide of the invention can have an analgesic peptide linked to its amino terminus and an anti-obesity peptide linked to its carboxy terminus. The additional moieties can be directly covalently bonded to the peptide or can be bonded via linkers.

The peptides of the invention can be a cyclic peptide or a linear peptide. In addition, multiple copies of the same peptide can be incorporated into a single cyclic or linear peptide.

The peptides can include the amino acid sequence of a peptide that occurs naturally in a vertebrate (e.g., mammalian) species or in a bacterial species. In addition, the peptides can be partially or completely non-naturally occurring peptides. Also within the invention are peptidomimetics corresponding to the peptides of the invention.

In various embodiments, the patient is suffering from a gastrointestinal disorder; the patient is suffering from a disorder selected from the group consisting of: a gastrointestinal motility disorder, irritable bowel syndrome, chronic constipation, post-operative ileus, a functional gastrointestinal disorder, gastroesophageal reflux disease, duodenogastric reflux, functional heartburn, dyspepsia, functional dyspepsia, nonulcer dyspepsia, gastroparesis, chronic intestinal pseudo-obstruction, Crohn's disease, ulcerative colitis, Irritable bowel syndrome, colonic pseudo-obstruction, obesity, congestive heart failure, or benign prostatic hyperplasia; the composition is administered orally; the peptide comprises 30 or fewer amino acids, the peptide comprises 20 or fewer amino acids, and the peptide comprises no more than 5 amino acids prior to $Cys_6$; the peptide comprises 150, 140, 130, 120, 110, 100, 90, 80, 70, 60, 50, 40, or 30 or fewer amino acids. In other embodiments, the peptide comprises 20 or fewer amino acids. In other embodiments the peptide comprises no more than 20, 15, 10, or 5 peptides subsequent to $Cys_{18}$. In certain embodiments $Xaa_{19}$ is a chymotrypsin or trypsin cleavage site and an analgesic peptide is present immediately following $Xaa_{19}$.

In a third aspect, the invention features a method for treating a patient suffering from constipation. Clinically accepted criteria that define constipation range from the frequency of bowel movements, the consistency of feces and the ease of bowel movement. One common definition of constipation is less than three bowel movements per week. Other definitions include abnormally hard stools or defecation that requires excessive straining (Schiller 2001, Aliment Pharmacol Ther 15:749-763). Constipation may be idiopathic (functional constipation or slow transit constipation) or secondary to other causes including neurologic, metabolic or endocrine disorders. These disorders include diabetes mellitus, hypothyroidism, hyperthyroidism, hypocalcaemia, Multiple Sclerosis, Parkinson's disease, spinal cord lesions, Neurofibromatosis, autonomic neuropathy, Chagas disease, Hirschsprung's disease and Cystic fibrosis. Constipation may also be the result of surgery (postoperative ileus) or due to the use of drugs such as analgesics (like opioids), antihypertensives, anticonvulsants, antidepressants, antispasmodics and antipsychotics. The method of treating constipation comprises administering a pharmaceutical composition comprising or consisting essentially of a peptide comprising, consisting of or consisting essentially of the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ (II) as described herein.

In various embodiments, the constipation is associated with use of a therapeutic agent; the constipation is associated with a neuropathic disorder; the constipation is post-surgical constipation (postoperative ileus); and the constipation associated with a gastrointestinal disorder; the constipation is idiopathic (functional constipation or slow transit constipation); the constipation is associated with neuropathic, metabolic or endocrine disorder (e.g., diabetes mellitus, hypothyroidism, hyperthyroidism, hypocalcaemia, Multiple Sclerosis, Parkinson's disease, spinal cord lesions, neurofibromatosis, autonomic neuropathy, Chagas disease, Hirschsprung's disease or cystic fibrosis). Constipation may also be the result of surgery (postoperative ileus) or due the use of drugs such as analgesics (e.g., opioids), antihypertensives, anticonvulsants, antidepressants, antispasmodics and antipsychotics.

In a fourth aspect, the invention features a method for treating a patient suffering a gastrointestinal disorder, the method comprising administering to the patient a pharmaceutical composition comprising or consisting essentially of a purified peptide comprising, consisting of or consisting essentially of the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ (II) as described herein.

In various embodiments, the patient is suffering from a gastrointestinal disorder; the patient is suffering from a disorder selected from the group consisting of: a gastrointestinal motility disorder, irritable bowel syndrome, chronic constipation, post-operative ileus, a functional gastrointestinal disorder, gastroesophageal reflux disease, functional heartburn, dyspepsia, functional dyspepsia, nonulcer dyspepsia, gastroparesis, chronic intestinal pseudo-obstruction, Crohn's disease, ulcerative colitis, Inflammatory bowel disease, colonic pseudo-obstruction, obesity, congestive heart failure, or benign prostatic hyperplasia.

In a fifth aspect, the invention features a method for increasing gastrointestinal motility in a patient, the method comprising administering to a patient a pharmaceutical composition comprising a purified peptide comprising, consisting of or consisting essentially of the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ (II) as described herein.

In a sixth aspect, the invention features a method for increasing the activity of (activating) an intestinal guanylate cyclase (GC-C) receptor in a patient, the method comprising administering to a patient a pharmaceutical composition comprising a purified peptide comprising, consisting of or consisting essentially of the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ (II) as described herein.

In a seventh aspect, the invention features an isolated nucleic acid molecule comprising a nucleotide sequence encoding a polypeptide comprising the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ (II) as described herein.

In an eighth aspect the invention features a method for treating constipation, the method comprising administering an agonist of the intestinal guanylate cyclase (GC-C) receptor. In various embodiments: the agonist is a peptide, the peptide includes two Cys that form one disulfide bond, the peptide includes four Cys that form two disulfide bonds, and the peptide includes six Cys that form three disulfide bonds.

In a ninth aspect, the invention features a method for treating a gastrointestinal disorder, a gastrointestinal motility disorder, irritable bowel syndrome, chronic constipation, post-operative ileus, a functional gastrointestinal disorder, gastroesophageal reflux disease, duodenogastric reflux, functional heartburn, dyspepsia, functional dyspepsia, nonulcer dyspepsia, gastroparesis, chronic intestinal pseudo-obstruction, colonic pseudo-obstruction, Crohn's disease, ulcerative colitis, Inflammatory bowel disease, obesity, congestive heart failure, or benign prostatic hyperplasia, the method comprising administering an agonist of the intestinal guanylate cyclase (GC-C) receptor either orally, by rectal suppository, or parenterally. In various embodiments: the agonist is a peptide, the peptide includes two Cys that form one disulfide bond, the peptide includes four Cys that form two disulfide bonds, and the peptide includes six Cys that form three disulfide bonds.

In a tenth aspect, the invention features a method for treating a gastrointestinal disorder selected from the group consisting of: a gastrointestinal motility disorder, irritable bowel syndrome, chronic constipation, post-operative ileus, a functional gastrointestinal disorder, gastroesophageal reflux disease, duodenogastric reflux, functional heartburn, dyspepsia, functional dyspepsia, nonulcer dyspepsia, gastroparesis, chronic intestinal pseudo-obstruction, colonic pseudo-obstruction, Crohn's disease, ulcerative colitis, Inflammatory bowel disease, the method comprising administering an agonist of the intestinal guanylate cyclase (GC-C) receptor. In various embodiments the composition is administered orally; the peptide comprises 30 or fewer amino acids, the peptide comprises 20 or fewer amino acids, and the peptide comprises no more than 5 amino acids prior to $Cys_5$.

In various embodiments: the agonist is a peptide, the peptide includes two Cys that form one disulfide bond, the peptide includes four Cys that form two disulfide bonds, and the peptide includes six Cys that form three disulfide bonds.

In an eleventh aspect, the invention features a method for treating obesity, the method comprising administering a complete or partial agonist of the intestinal guanylate cyclase (GC-C) receptor. In various embodiments: the agonist is a peptide, the peptide includes two Cys that form one disulfide bond, the peptide includes four Cys that form two disulfide bonds, and the peptide includes six Cys that form three disulfide bonds. The agonist can be administered alone or in combination with one or more agents for treatment of obesity, including but not limited to the anti-obesity agents described herein. Thus, for example, $PYY_{3-36}$ can be fused to the carboxy or amino terminus of a peptide of the invention. Such a fusion protein can include a chymostrypsin or trypsin cleavage site that can permit cleavage to separate the two peptides.

In a twelfth aspect, the invention features a method for treating obesity, the method comprising administering to a patient a pharmaceutical composition comprising or consisting essentially of a purified peptide comprising, consisting of or consisting essentially of the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ (II) as described herein.

In a thirteenth aspect, the invention features a composition comprising or consisting essentially of a purified peptide comprising, consisting of or consisting essentially of the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ (II) as described herein. In one embodiment, the composition is a pharmaceutical composition.

In a fourteenth aspect, the invention features a method for treating congestive heart failure, the method comprising administering to a patient a pharmaceutical composition comprising or consisting essentially of a purified peptide comprising, consisting of or consisting essentially of the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ (II) as described herein.

The peptide can be administered in combination with one or more agents for treatment of congestive heart failure, for example, a natriuretic peptide such as atrial natriuretic peptide, brain natriuretic peptide or C-type natriuretic peptide), a diuretic, or an inhibitor of angiotensin converting enzyme.

In a fifteenth aspect, the invention features a method for treating benign prostatic hyperplasia, the method comprising administering to a patient a pharmaceutical composition comprising a purified peptide comprising, consisting of or consisting essentially of the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ (II) as described herein. The peptide can be administered alone or in combination with another agent for treatment of BPH, for example, a 5-alpha reductase inhibitor (e.g., finasteride) or an alpha adrenergic inhibitor (e.g., doxazosine).

In a sixteenth aspect, the invention features a method for treating or reducing pain, including visceral pain, pain associated with a gastrointestinal disorder or pain associated with some other disorder, the method comprising administering to a patient a pharmaceutical composition comprising or consisting essentially of a purified peptide comprising, consisting of or consisting essentially of the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_7$ $Cys_{18}$ $Xaa_{19}$ $Xaa_{20}$ $Xaa_{21}$ (II) as described herein.

In a seventeenth aspect, the invention features a method for treating inflammation, including inflammation of the gastrointestinal tract, e.g., inflammation associated with a gastrointestinal disorder or infection or some other disorder, the method comprising administering to a patient a pharmaceutical composition comprising a purified peptide comprising, consisting of or consisting essentially of the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ (II) as described herein.

In an eighteenth aspect, the invention features a method for treating congestive heart failure, the method comprising administering a complete or partial agonist of the intestinal guanylate cyclase (GC-C) receptor. The agonist can be administered alone or in combination with another agent for treatment of congestive heart failure, for example, a natriuretic peptide such as atrial natriuretic peptide, brain natriuretic peptide or C-type natriuretic peptide, a diuretic, or an inhibitor of angiotensin converting enzyme.

In a nineteenth aspect, the invention features a method for treating BPH, the method comprising administering a complete or partial agonist of the intestinal guanylate cyclase (GC-C) receptor. The agonist can be administered alone or in combination with another agent for treatment of BPH, for example, a 5-alpha reductase inhibitor (e.g., finasteride) or an alpha adrenergic inhibitor (e.g., doxazosine).

In a twentieth aspect, the invention features isolated nucleic acid molecules comprising a sequence encoding a peptide of the invention. Also within the invention are vectors, e.g., expression vectors that include such nucleic acid molecules and can be used to express a peptide of the invention in a cultured cell (e.g., a eukaryotice cell or a prokaryotic cell). The vector can further include one or more regulatory elements, e.g., a heterologous promoter or elements required for translation operably linked to the sequence encoding the peptide. In some cases the nucleic acid molecule will encode an amino acid sequence that includes the amino acid sequence of a peptide of the invention. For example, the nucleic acid molecule can encode a preprotein or a preproprotein that can be processed to produce a peptide of the invention.

A vector that includes a nucleotide sequence encoding a peptide of the invention or a peptide or polypeptide comprising a peptide of the invention may be either RNA or DNA, single- or double-stranded, prokaryotic, eukaryotic, or viral. Vectors can include transposons, viral vectors, episomes, (e.g., plasmids), chromosomes inserts, and artificial chromosomes (e.g. BACs or YACs). Suitable bacterial hosts for expression of the encode peptide or polypeptide include, but are not limited to, *E. coli*. Suitable eukaryotic hosts include yeast such as *S. cerevisiae*, other fungi, vertebrate cells, invertebrate cells (e.g., insect cells), plant cells, human cells, human tissue cells, and whole eukaryotic organisms. (e.g., a transgenic plant or a transgenic animal). Further, the vector nucleic acid can be used to transfect a virus such as vaccinia or baculovirus (for example using the Bac-to-Bac® Baculovirus expression system (Invitrogen Life Technologies, Carlsbad, Calif.)).

As noted above the invention includes vectors and genetic constructs suitable for production of a peptide of the invention or a peptide or polypeptide comprising such a peptide. Generally, the genetic construct also includes, in addition to the encoding nucleic acid molecule, elements that allow expression, such as a promoter and regulatory sequences. The expression vectors may contain transcriptional control sequences that control transcriptional initiation, such as promoter, enhancer, operator, and repressor sequences. A variety of transcriptional control sequences are well known to those in the art and may be functional in, but are not limited to, a bacterium, yeast, plant, or animal cell. The expression vector can also include a translation regulatory sequence (e.g., an untranslated 5' sequence, an untranslated 3' sequence, a poly A addition site, or an internal ribosome entry site), a splicing sequence or splicing regulatory sequence, and a transcription termination sequence. The vector can be capable of autonomous replication or it can integrate into host DNA.

The invention also includes isolated host cells harboring one of the forgoing nucleic acid molecules and methods for producing a peptide by culturing such a cell and recovering the peptide or a precursor of the peptide. Recovery of the peptide or precursor may refer to collecting the growth solution and need not involve additional steps of purification. Proteins of the present invention, however, can be purified using standard purification techniques, such as, but not limited to, affinity chromatography, thermaprecipitation, immunoaffinity chromatography, ammonium sulfate precipitation, ion exchange chromatography, filtration, electrophoresis and hydrophobic interaction chromatography.

The peptides can be purified. Purified peptides are peptides separated from other proteins, lipids, and nucleic acids or from the compounds from which is it synthesized. The polypeptide can constitute at least 10, 20, 50 70, 80 or 95% by dry weight of the purified preparation.

In a twenty-first aspect, the invention features a method of increasing the level of cyclic guanosine 3'-monophosphate (cGMP) in an organ, tissue (e.g, the intestinal mucosa), or cell (e.g., a cell bearing GC-A receptor) by administering to a patient a composition comprising or consisting essentially of a purified peptide comprising, consisting of or consisting essentially of the amino acid sequence: $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ (I) or $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Asn_{12}$ $Pro_{13}$ $Ala_{14}$ $Cys_{15}$ $Xaa_{16}$ $Gly_{17}$ $Cys_{18}$ $Xaa_{19}$ $Xaa_{20}$ $Xaa_{21}$ (II) as described herein.

In a twenty-second aspect, the invention features polypeptides comprising, consisting or consisting essentially of the amino acid sequence $Xaa_1$ $Xaa_2$ $Xaa_3$ $Xaa_4$ $Xaa_5$ $Cys_6$ $Cys_7$ $Xaa_8$ $Xaa_9$ $Cys_{10}$ $Cys_{11}$ $Xaa_{12}$ $Xaa_{13}$ $Xaa_{14}$ $Cys_{15}$ $Xaa_{16}$ $Xaa_{17}$ $Cys_{18}$ $Xaa_{19}$ $Xaa_{20}$ $Xaa_{21}$ wherein: a) $Xaa_8$ or $Xaa_9$ is not present; b) neither $Xaa_8$ or $Xaa_9$ is present; c) one of $Xaa_{12}$, $Xaa_{13}$ and $Xaa_{14}$ is not present; d) two of $Xaa_{12}$, $Xaa_{13}$ and $Xaa_{14}$ are not present; e) three of $Xaa_{12}$, $Xaa_{13}$ and $Xaa_{14}$ are not present; f) one of $Xaa_{16}$ and $Xaa_{17}$ is not present; g) neither $Xaa_{16}$ or $Xaa_{17}$ is present and combinations thereof. In various embodiments, one, two, three, four or five of $Xaa_1$ $Xaa_2$ $Xaa_3$ $Xaa_4$ and $Xaa_5$ are not present. In other embodiments, one, two or three or $Xaa_{19}$ $Xaa_{20}$ and $Xaa_{21}$ are missing.

In twenty third aspect, the invention features a method for treating a disorder ameliorated by increasing cGMP levels, the method comprising administering a pharmaceutical composition comprising, consisting essentially of or consisting of a peptide or agonist of the invention and a pharmaceutically acceptable carrier.

Among the useful peptides are peptides comprising, consisting of or consisting essentially of the amino acid sequence $Xaa_1$ $Xaa_2$ $Xaa_3$ $Xaa_4$ $Xaa_5$ Cys Cys Glu $Xaa_9$ Cys Cys Asn Pro Ala Cys Thr Gly Cys Tyr $Xaa_{20}$ $Xaa_{21}$ (II) (SEQ ID NO:2) are the following peptides:

```
Gln Ser Ser Asn Tyr Cys Cys Glu Tyr Cys Cys Asn Pro Ala Cys Thr Gly Cys Tyr   (SEQ ID NO: 37)
Asn Thr Ser Asn Tyr Cys Cys Glu Tyr Cys Cys Asn Pro Ala Cys Thr Gly Cys Tyr   (SEQ ID NO: 38)
Asn Leu Ser Asn Tyr Cys Cys Glu Tyr Cys Cys Asn Pro Ala Cys Thr Gly Cys Tyr   (SEQ ID NO: 39)
Asn Ile Ser Asn Tyr Cys Cys Glu Tyr Cys Cys Asn Pro Ala Cys Thr Gly Cys Tyr   (SEQ ID NO: 40)
Asn Ser Ser Gln Tyr Cys Cys Glu Tyr Cys Cys Asn Pro Ala Cys Thr Gly Cys Tyr   (SEQ ID NO: 41)
Ser Ser Asn Tyr Cys Cys Glu Tyr Cys Cys Asn Pro Ala Cys Thr Gly Cys Tyr       (SEQ ID NO: 42)
Gln Ser Ser Gln Tyr Cys Cys Glu Tyr Cys Cys Asn Pro Ala Cys Thr Gly Cys Tyr   (SEQ ID NO: 43)
Ser Ser Gln Tyr Cys Cys Glu Tyr Cys Cys Asn Pro Ala Cys Thr Gly Cys Tyr.      (SEQ ID NO: 44)
Asn Ser Ser Asn Tyr Cys Cys Glu Ala Cys Cys Asn Pro Ala Cys Thr Gly Cys Tyr   (SEQ ID NO: 45)
Asn Ser Ser Asn Tyr Cys Cys Glu Arg Cys Cys Asn Pro Ala Cys Thr Gly Cys Tyr   (SEQ ID NO: 46)
Asn Ser Ser Asn Tyr Cys Cys Glu Asn Cys Cys Asn Pro Ala Cys Thr Gly Cys Tyr   (SEQ ID NO: 47)
Asn Ser Ser Asn Tyr Cys Cys Glu Asp Cys Cys Asn Pro Ala Cys Thr Gly Cys Tyr   (SEQ ID NO: 48)
Asn Ser Ser Asn Tyr Cys Cys Glu Cys Cys Asn Pro Ala Cys Thr Gly Cys Tyr       (SEQ ID NO: 49)
Asn Ser Ser Asn Tyr Cys Cys Glu Gln Cys Cys Asn Pro Ala Cys Thr Gly Cys Tyr   (SEQ ID NO: 50)
Asn Ser Ser Asn Tyr Cys Cys Glu Glu Cys Cys Asn Pro Ala Cys Thr Gly Cys Tyr   (SEQ ID NO: 51)
Asn Ser Ser Asn Tyr Cys Cys Glu Gly Cys Cys Asn Pro Ala Cys Thr Gly Cys Tyr   (SEQ ID NO: 52)
Asn Ser Ser Asn Tyr Cys Cys Glu His Cys Cys Asn Pro Ala Cys Thr Gly Cys Tyr   (SEQ ID NO: 53)
Asn Ser Ser Asn Tyr Cys Cys Glu Ile Cys Cys Asn Pro Ala Cys Thr Gly Cys Tyr   (SEQ ID NO: 54)
Asn Ser Ser Asn Tyr Cys Cys Glu Lys Cys Cys Asn Pro Ala Cys Thr Gly Cys Tyr   (SEQ ID NO: 55)
Asn Ser Ser Asn Tyr Cys Cys Glu Met Cys Cys Asn Pro Ala Cys Thr Gly Cys Tyr   (SEQ ID NO: 56)
Asn Ser Ser Asn Tyr Cys Cys Glu Phe Cys Cys Asn Pro Ala Cys Thr Gly Cys Tyr   (SEQ ID NO: 57)
Asn Ser Ser Asn Tyr Cys Cys Glu Pro Cys Cys Asn Pro Ala Cys Thr Gly Cys Tyr   (SEQ ID NO: 58)
Asn Ser Ser Asn Tyr Cys Cys Glu Ser Cys Cys Asn Pro Ala Cys Thr Gly Cys Tyr   (SEQ ID NO: 59)
Asn Ser Ser Asn Tyr Cys Cys Glu Thr Cys Cys Asn Pro Ala Cys Thr Gly Cys Tyr   (SEQ ID NO: 60)
Asn Ser Ser Asn Tyr Cys Cys Glu Trp Cys Cys Asn Pro Ala Cys Thr Gly Cys Tyr   (SEQ ID NO: 61)
Asn Ser Ser Asn Tyr Cys Cys Glu Val Cys Cys Asn Pro Ala Cys Thr Gly Cys Tyr   (SEQ ID NO: 62)
Cys Cys Glu Ala Cys Cys Asn Pro Ala Cys Thr Gly Cys Tyr                       (SEQ ID NO: 63)
Cys Cys Glu Arg Cys Cys Asn Pro Ala Cys Thr Gly Cys Tyr                       (SEQ ID NO: 64)
Cys Cys Glu Asn Cys Cys Asn Pro Ala Cys Thr Gly Cys Tyr                       (SEQ ID NO: 65)
Cys Cys Glu Asp Cys Cys Asn Pro Ala Cys Thr Gly Cys Tyr                       (SEQ ID NO: 66)
Cys Cys Glu Cys Cys Asn Pro Ala Cys Thr Gly Cys Tyr                           (SEQ ID NO: 67)
Cys Cys Glu Gln Cys Cys Asn Pro Ala Cys Thr Gly Cys Tyr                       (SEQ ID NO: 68)
Cys Cys Glu Glu Cys Cys Asn Pro Ala Cys Thr Gly Cys Tyr                       (SEQ ID NO: 69)
Cys Cys Glu Gly Cys Cys Asn Pro Ala Cys Thr Gly Cys Tyr                       (SEQ ID NO: 70)
Cys Cys Glu His Cys Cys Asn Pro Ala Cys Thr Gly Cys Tyr                       (SEQ ID NO: 71)
Cys Cys Glu Ile Cys Cys Asn Pro Ala Cys Thr Gly Cys Tyr                       (SEQ ID NO: 72)
Cys Cys Glu Lys Cys Cys Asn Pro Ala Cys Thr Gly Cys Tyr                       (SEQ ID NO: 73)
Cys Cys Glu Met Cys Cys Asn Pro Ala Cys Thr Gly Cys Tyr                       (SEQ ID NO: 74)
Cys Cys Glu Phe Cys Cys Asn Pro Ala Cys Thr Gly Cys Tyr                       (SEQ ID NO: 75)
Cys Cys Glu Pro Cys Cys Asn Pro Ala Cys Thr Gly Cys Tyr                       (SEQ ID NO: 76)
```

Cys Cys Glu Ser Cys Cys Asn Pro Ala Cys Thr Gly Cys Tyr (SEQ ID NO: 77)

Cys Cys Glu Thr Cys Cys Asn Pro Ala Cys Thr Gly Cys Tyr (SEQ ID NO: 78)

Cys Cys Glu Trp Cys Cys Asn Pro Ala Cys Thr Gly Cys Tyr (SEQ ID NO: 79)

Cys Cys Glu Val Cys Cys Asn Pro Ala Cys Thr Gly Cys Tyr (SEQ ID NO: 80)

Cys Cys Glu Tyr Cys Cys Asn Pro Ala Cys Thr Gly Cys (SEQ ID NO: 81)

Cys Cys Glu Ala Cys Cys Asn Pro Ala Cys Thr Gly Cys (SEQ ID NO: 82)

Cys Cys Glu Arg Cys Cys Asn Pro Ala Cys Thr Gly Cys (SEQ ID NO: 83)

Cys Cys Glu Asn Cys Cys Asn Pro Ala Cys Thr Gly Cys (SEQ ID NO: 84)

Cys Cys Glu Asp Cys Cys Asn Pro Ala Cys Thr Gly Cys (SEQ ID NO: 85)

Cys Cys Glu Cys Cys Cys Asn Pro Ala Cys Thr Gly Cys (SEQ TD NO: 86)

Cys Cys Glu Gln Cys Cys Asn Pro Ala Cys Thr Gly Cys (SEQ ID NO: 87)

Cys Cys Glu Glu Cys Cys Asn Pro Ala Cys Thr Gly Cys (SEQ ID NO: 88)

Cys Cys Glu Gly Cys Cys Asn Pro Ala Cys Thr Gly Cys (SEQ ID NO: 89)

Cys Cys Glu His Cys Cys Asn Pro Ala Cys Thr Gly Cys (SEQ ID NO: 90)

Cys Cys Glu Ile Cys Cys Asn Pro Ala Cys Thr Gly Cys (SEQ ID NO: 91)

Cys Cys Glu Lys Cys Cys Asn Pro Ala Cys Thr Gly Cys (SEQ ID NO: 92)

Cys Cys Glu Met Cys Cys Asn Pro Ala Cys Thr Gly Cys (SEQ ID NO: 93)

Cys Cys Glu Phe Cys Cys Asn Pro Ala Cys Thr Gly Cys (SEQ ID NO: 94)

Cys Cys Glu Pro Cys Cys Asn Pro Ala Cys Thr Gly Cys (SEQ ID NO: 95)

Cys Cys Glu Ser Cys Cys Asn Pro Ala Cys Thr Gly Cys (SEQ ID NO: 96)

Cys Cys Glu Thr Cys Cys Asn Pro Ala Cys Thr Gly Cys; (SEQ ID NO: 97)

Cys Cys Glu Trp Cys Cys Asn Pro Ala Cys Thr Gly Cys (SEQ ID NO: 98)

Cys Cys Glu Val Cys Cys Asn Pro Ala Cys Thr Gly Cys. (SEQ ID NO: 99)

Also useful are peptides comprising, consisting of or consisting essentially of any of the following sequences SEQ ID NOs 1669-2080, respectively:

Cys Cys Glu Leu Cys Cys Ala Pro Ala Cys Thr Gly Cys Tyr

Cys Cys Glu Leu Cys Cys Val Pro Ala Cys Thr Gly Cys Tyr

Cys Cys Glu Leu Cys Cys Leu Pro Ala Cys Thr Gly Cys Tyr

Cys Cys Glu Leu Cys Cys Ile Pro Ala Cys Thr Gly Cys Tyr

Cys Cys Glu Leu Cys Cys Pro Pro Ala Cys Thr Gly Cys Tyr

Cys Cys Gln Leu Cys Cys Met Pro Ala Cys Thr Gly Cys Tyr

Cys Cys Glu Leu Cys Cys Phe Pro Ala Cys Thr Gly Cys Tyr

Cys Cys Gln Leu Cys Cys Trp Pro Ala Cys Thr Gly Cys Tyr

Cys Cys Gln Leu Cys Cys Gly Pro Ala Cys Thr Gly Cys Tyr

Cys Cys Gln Leu Cys Cys Ser Pro Ala Cys Thr Gly Cys Tyr

Cys Cys Gln Leu Cys Cys Thr Pro Ala Cys Thr Gly Cys Tyr

Cys Cys Gln Leu Cys Cys Cys Pro Ala Cys Thr Gly Cys Tyr

Cys Cys Gln Leu Cys Cys Gln Pro Ala Cys Thr Gly Cys Tyr

-continued

Cys Cys Gln Leu Cys Cys Tyr Pro Ala Cys Thr Gly
Cys Tyr

Cys Cys Gln Leu Cys Cys Asp Pro Ala Cys Thr Gly
Cys Tyr

Cys Cys Gln Leu Cys Cys Gln Pro Ala Cys Thr Gly
Cys Tyr

Cys Cys Gln Leu Cys Cys Lys Pro Ala Cys Thr Gly
Cys Tyr

Cys Cys Gln Leu Cys Cys Arg Pro Ala Cys Thr Gly
Cys Tyr

Cys Cys Gln Leu Cys Cys His Pro Ala Cys Thr Gly
Cys Tyr

Cys Cys Gln Tyr Cys Cys Ala Pro Ala Cys Thr Gly
Cys Tyr

Cys Cys Gln Tyr Cys Cys Val Pro Ala Cys Thr Gly
Cys Tyr

Cys Cys Gln Tyr Cys Cys Leu Pro Ala Cys Thr Gly
Cys Tyr

Cys Cys Gln Tyr Cys Cys Ile Pro Ala Cys Thr Gly
Cys Tyr

Cys Cys Gln Tyr Cys Cys Pro Pro Ala Cys Thr Gly
Cys Tyr

Cys Cys Gln Tyr Cys Cys Met Pro Ala Cys Thr Gly
Cys Tyr

Cys Cys Gln Tyr Cys Cys Phe Pro Ala Cys Thr Gly
Cys Tyr

Cys Cys Gln Tyr Cys Cys Trp Pro Ala Cys Thr Gly
Cys Tyr

Cys Cys Gln Tyr Cys Cys Gly Pro Ala Cys Thr Gly
Cys Tyr

Cys Cys Gln Tyr Cys Cys Ser Pro Ala Cys Thr Gly
Cys Tyr

Cys Cys Gln Tyr Cys Cys Thr Pro Ala Cys Thr Gly
Cys Tyr

Cys Cys Gln Tyr Cys Cys Cys Pro Ala Cys Thr Gly
Cys Tyr

Cys Cys Gln Tyr Cys Cys Gln Pro Ala Cys Thr Gly
Cys Tyr

Cys Cys Gln Tyr Cys Cys Tyr Pro Ala Cys Thr Gly
Cys Tyr

-continued

Cys Cys Gln Tyr Cys Cys Asp Pro Ala Cys Thr Gly
Cys Tyr

Cys Cys Gln Tyr Cys Cys Gln Pro Ala Cys Thr Gly
Cys Tyr

Cys Cys Glu Tyr Cys Cys Lys Pro Ala Cys Thr Gly
Cys Tyr

Cys Cys Glu Tyr Cys Cys Arg Pro Ala Cys Thr Gly
Cys Tyr

Cys Cys Glu Tyr Cys Cys His Pro Ala Cys Thr Gly
Cys Tyr

Cys Cys Glu Leu Cys Cys Ala Pro Ala Cys Thr Gly
Cys

Cys Cys Glu Leu Cys Cys Val Pro Ala Cys Thr Gly
Cys

Cys Cys Glu Leu Cys Cys Leu Pro Ala Cys Thr Gly
Cys

Cys Cys Glu Leu Cys Cys Ile Pro Ala Cys Thr Gly
Cys

Cys Cys Glu Leu Cys Cys Pro Pro Ala Cys Thr Gly
Cys

Cys Cys Glu Leu Cys Cys Met Pro Ala Cys Thr Gly
Cys

Cys Cys Glu Leu Cys Cys Phe Pro Ala Cys Thr Gly
Cys

Cys Cys Glu Leu Cys Cys Trp Pro Ala Cys Thr Gly
Cys

Cys Cys Glu Leu Cys Cys Gly Pro Ala Cys Thr Gly
Cys

Cys Cys Glu Leu Cys Cys Ser Pro Ala Cys Thr Gly
Cys

Cys Cys Glu Leu Cys Cys Thr Pro Ala Cys Thr Gly
Cys

Cys Cys Glu Leu Cys Cys Cys Pro Ala Cys Thr Gly
Cys

Cys Cys Glu Leu Cys Cys Gln Pro Ala Cys Thr Gly
Cys

Cys Cys Glu Leu Cys Cys Tyr Pro Ala Cys Thr Gly
Cys

Cys Cys Glu Leu Cys Cys Asp Pro Ala Cys Thr Gly
Cys

-continued

Cys Cys Glu Leu Cys Cys Glu Pro Ala Cys Thr Gly Cys

Cys Cys Glu Leu Cys Cys Lys Pro Ala Cys Thr Gly Cys

Cys Cys Glu Leu Cys Cys Arg Pro Ala Cys Thr Gly Cys

Cys Cys Glu Leu Cys Cys His Pro Ala Cys Thr Gly Cys

Cys Cys Glu Tyr Cys Cys Ala Pro Ala Cys Thr Gly Cys

Cys Cys Glu Tyr Cys Cys Val Pro Ala Cys Thr Gly Cys

Cys Cys Glu Tyr Cys Cys Leu Pro Ala Cys Thr Gly Cys

Cys Cys Glu Tyr Cys Cys Ile Pro Ala Cys Thr Gly Cys

Cys Cys Glu Tyr Cys Cys Pro Pro Ala Cys Thr Gly Cys

Cys Cys Glu Tyr Cys Cys Met Pro Ala Cys Thr Gly Cys

Cys Cys Glu Tyr Cys Cys Phe Pro Ala Cys Thr Gly Cys

Cys Cys Glu Tyr Cys Cys Tyr Pro Ala Cys Thr Gly Cys

Cys Cys Glu Tyr Cys Cys Gly Pro Ala Cys Thr Gly Cys

Cys Cys Glu Tyr Cys Cys Ser Pro Ala Cys Thr Gly Cys

Cys Cys Glu Tyr Cys Cys Thr Pro Ala Cys Thr Gly Cys

Cys Cys Glu Tyr Cys Cys Cys Pro Ala Cys Thr Gly Cys

Cys Cys Glu Tyr Cys Cys Gln Pro Ala Cys Thr Gly Cys

Cys Cys Glu Tyr Cys Cys Tyr Pro Ala Cys Thr Gly Cys

Cys Cys Glu Tyr Cys Cys Asp Pro Ala Cys Thr Gly Cys

Cys Cys Glu Tyr Cys Cys Glu Pro Ala Cys Thr Gly Cys

Cys Cys Glu Tyr Cys Cys Lys Pro Ala Cys Thr Gly Cys

Cys Cys Glu Tyr Cys Cys Arg Pro Ala Cys Thr Gly Cys

Cys Cys Glu Tyr Cys Cys His Pro Ala Cys Thr Gly Cys

Cys Cys Glu Leu Cys Cys Asn Pro Thr Cys Thr Gly Cys Tyr

Cys Cys Glu Tyr Cys Cys Asn Pro Thr Cys Thr Gly Cys Tyr

Cys Cys Glu Leu Cys Cys Asn Pro Thr Cys Thr Gly Cys

Cys Cys Glu Tyr Cys Cys Asn Pro Thr Cys Thr Gly Cys

Cys Cys Glu Phe Cys Cys Asn Pro Thr Cys Thr Gly Cys Tyr

Cys Cys Glu Phe Cys Cys Asn Pro Thr Cys Thr Gly Cys

Cys Cys Glu Trp Cys Cys Asn Pro Thr Cys Thr Gly Cys Tyr

Cys Cys Glu Trp Cys Cys Asn Pro Thr Cys Thr Gly Cys

Cys Cys Glu Leu Cys Cys Asn Gly Ala Cys Thr Gly Cys Tyr

Cys Cys Glu Tyr Cys Cys Asn Gly Ala Cys Thr Gly Cys Tyr

Cys Cys Glu Leu Cys Cys Asn Gly Ala Cys Thr Gly Cys

Cys Cys Glu Tyr Cys Cys Asn Gly Ala Cys Thr Gly Cys

Cys Cys Glu Phe Cys Cys Asn Gly Ala Cys Thr Gly Cys Tyr

Cys Cys Glu Phe Cys Cys Asn Gly Ala Cys Thr Gly Cys

Cys Cys Glu Trp Cys Cys Asn Gly Ala Cys Thr Gly Cys Tyr

Cys Cys Glu Trp Cys Cys Asn Gly Ala Cys Thr Gly Cys

Cys Cys Glu Leu Cys Cys Asn Pro Ala Cys Val Gly Cys Tyr

-continued

Cys Cys Glu Tyr Cys Cys Asn Pro Ala Cys Val Gly
Cys Tyr

Cys Cys Glu Leu Cys Cys Asn Pro Ala Cys Val Gly
Cys

Cys Cys Glu Tyr Cys Cys Asn Pro Ala Cys Val Gly
Cys

Cys Cys Glu Phe Cys Cys Asn Pro Ala Cys Val Gly
Cys Tyr

Cys Cys Glu Phe Cys Cys Asn Pro Ala Cys Val Gly
Cys

Cys Cys Glu Trp Cys Cys Asn Pro Ala Cys Val Gly
Cys Tyr

Cys Cys Glu Trp Cys Cys Asn Pro Ala Cys Val Gly
Cys

Cys Cys Glu Leu Cys Cys Asn Pro Ala Cys Gly Gly
Cys Tyr

Cys Cys Glu Tyr Cys Cys Asn Pro Ala Cys Gly Gly
Cys Tyr

Cys Cys Glu Leu Cys Cys Asn Pro Ala Cys Gly Gly
Cys

Cys Cys Glu Tyr Cys Cys Asn Pro Ala Cys Gly Gly
Cys

Cys Cys Glu Phe Cys Cys Asn Pro Ala Cys Gly Gly
Cys Tyr

Cys Cys Glu Phe Cys Cys Asn Pro Ala Cys Gly Gly
Cys

Cys Cys Glu Trp Cys Cys Asn Pro Ala Cys Gly Gly
Cys Tyr

Cys Cys Glu Trp Cys Cys Asn Pro Ala Cys Gly Gly
Cys

Cys Cys Glu Leu Cys Cys Asn Pro Ala Cys Thr Ala
Cys Tyr

Cys Cys Glu Tyr Cys Cys Asn Pro Ala Cys Thr Ala
Cys Tyr

Cys Cys Glu Leu Cys Cys Asn Pro Ala Cys Thr Ala
Cys

Cys Cys Glu Tyr Cys Cys Asn Pro Ala Cys Thr Ala
Cys

Cys Cys Glu Trp Cys Cys Asn Pro Ala Cys Thr Ala
Cys Tyr

-continued

Cys Cys Glu Trp Cys Cys Asn Pro Ala Cys Thr Ala
Cys

Cys Cys Glu Phe Cys Cys Asn Pro Ala Cys Thr Ala
Cys Tyr

Cys Cys Glu Phe Cys Cys Asn Pro Ala Cys Thr Ala
Cys

Cys Cys Glu Leu Cys Cys Asn Pro Ala Cys Thr Gly
Cys Ala

Cys Cys Glu Leu Cys Cys Asn Pro Ala Cys Thr Gly
Cys Val

Cys Cys Glu Leu Cys Cys Asn Pro Ala Cys Thr Gly
Cys Leu

Cys Cys Glu Leu Cys Cys Asn Pro Ala Cys Thr Gly
Cys Ile

Cys Cys Glu Leu Cys Cys Asn Pro Ala Cys Thr Gly
Cys Pro

Cys Cys Glu Leu Cys Cys Asn Pro Ala Cys Thr Gly
Cys Met

Cys Cys Glu Leu Cys Cys Asn Pro Ala Cys Thr Gly
Cys Phe

Cys Cys Glu Leu Cys Cys Asn Pro Ala Cys Thr Gly
Cys Trp

Cys Cys Glu Leu Cys Cys Asn Pro Ala Cys Thr Gly
Cys Gly

Cys Cys Glu Leu Cys Cys Asn Pro Ala Cys Thr Gly
Cys Ser

Cys Cys Glu Leu Cys Cys Asn Pro Ala Cys Thr Gly
Cys Thr

Cys Cys Glu Leu Cys Cys Asn Pro Ala Cys Thr Gly
Cys Cys

Cys Cys Glu Leu Cys Cys Asn Pro Ala Cys Thr Gly
Cys Asn

Cys Cys Glu Leu Cys Cys Asn Pro Ala Cys Thr Gly
Cys Gln

Cys Cys Glu Leu Cys Cys Asn Pro Ala Cys Thr Gly
Cys Asp

Cys Cys Glu Leu Cys Cys Asn Pro Ala Cys Thr Gly
Cys Glu

Cys Cys Glu Leu Cys Cys Asn Pro Ala Cys Thr Gly
Cys Lys

Cys Cys Glu Leu Cys Cys Asn Pro Ala Cys Thr Gly
Cys Arg

Cys Cys Glu Leu Cys Cys Asn Pro Ala Cys Thr Gly
Cys His

Cys Cys Glu Tyr Cys Cys Asn Pro Ala Cys Thr Gly
Cys Ala

Cys Cys Glu Tyr Cys Cys Asn Pro Ala Cys Thr Gly
Cys Val

Cys Cys Glu Tyr Cys Cys Asn Pro Ala Cys Thr Gly
Cys Leu

Cys Cys Glu Tyr Cys Cys Asn Pro Ala Cys Thr Gly
Cys Ile

Cys Cys Glu Tyr Cys Cys Asn Pro Ala Cys Thr Gly
Cys Pro

Cys Cys Glu Tyr Cys Cys Asn Pro Ala Cys Thr Gly
Cys Met

Cys Cys Glu Tyr Cys Cys Asn Pro Ala Cys Thr Gly
Cys Phe

Cys Cys Glu Tyr Cys Cys Asn Pro Ala Cys Thr Gly
Cys Trp

Cys Cys Glu Tyr Cys Cys Asn Pro Ala Cys Thr Gly
Cys Gly

Cys Cys Glu Tyr Cys Cys Asn Pro Ala Cys Thr Gly
Cys Ser

Cys Cys Glu Tyr Cys Cys Asn Pro Ala Cys Thr Gly
Cys Thr

Cys Cys Glu Tyr Cys Cys Asn Pro Ala Cys Thr Gly
Cys Cys

Cys Cys Glu Tyr Cys Cys Asn Pro Ala Cys Thr Gly
Cys Asn

Cys Cys Glu Tyr Cys Cys Asn Pro Ala Cys Thr Gly
Cys Gln

Cys Cys Glu Tyr Cys Cys Asn Pro Ala Cys Thr Gly
Cys Asp

Cys Cys Glu Tyr Cys Cys Asn Pro Ala Cys Thr Gly
Cys Glu

Cys Cys Glu Tyr Cys Cys Asn Pro Ala Cys Thr Gly
Cys Lys

Cys Cys Glu Tyr Cys Cys Asn Pro Ala Cys Thr Gly
Cys Arg

Cys Cys Glu Tyr Cys Cys Asn Pro Ala Cys Thr Gly
Cys His

Cys Cys Ala Leu Cys Cys Asn Pro Ala Cys Thr Gly
Cys Tyr

Cys Cys Val Leu Cys Cys Asn Pro Ala Cys Thr Gly
Cys Tyr

Cys Cys Leu Leu Cys Cys Asn Pro Ala Cys Thr Gly
Cys Tyr

Cys Cys Ile Leu Cys Cys Asn Pro Ala Cys Thr Gly
Cys Tyr

Cys Cys Met Leu Cys Cys Asn Pro Ala Cys Thr Gly
Cys Tyr

Cys Cys Phe Leu Cys Cys Asn Pro Ala Cys Thr Gly
Cys Tyr

Cys Cys Trp Leu Cys Cys Asn Pro Ala Cys Thr Gly
Cys Tyr

Cys Cys Gly Leu Cys Cys Asn Pro Ala Cys Thr Gly
Cys Tyr

Cys Cys Ser Leu Cys Cys Asn Pro Ala Cys Thr Gly
Cys Tyr

Cys Cys Thr Leu Cys Cys Asn Pro Ala Cys Thr Gly
Cys Tyr

Cys Cys Cys Leu Cys Cys Asn Pro Ala Cys Thr Gly
Cys Tyr

Cys Cys Asn Leu Cys Cys Asn Pro Ala Cys Thr Gly
Cys Tyr

Cys Cys Gln Leu Cys Cys Asn Pro Ala Cys Thr Gly
Cys Tyr

Cys Cys Tyr Leu Cys Cys Asn Pro Ala Cys Thr Gly
Cys Tyr

Cys Cys Asp Leu Cys Cys Asn Pro Ala Cys Thr Gly
Cys Tyr

Cys Cys Lys Leu Cys Cys Asn Pro Ala Cys Thr Gly
Cys Tyr

Cys Cys Arg Leu Cys Cys Asn Pro Ala Cys Thr Gly
Cys Tyr

Cys Cys His Leu Cys Cys Asn Pro Ala Cys Thr Gly
Cys Tyr

Cys Cys Ala Leu Cys Cys Asn Pro Ala Cys Thr Gly
Cys

-continued

Cys Cys Val Leu Cys Cys Asn Pro Ala Cys Thr Gly
Cys

Cys Cys Leu Leu Cys Cys Asn Pro Ala Cys Thr Gly
Cys

Cys Cys Ile Leu Cys Cys Asn Pro Ala Cys Thr Gly
Cys

Cys Cys Met Leu Cys Cys Asn Pro Ala Cys Thr Gly
Cys

Cys Cys Phe Leu Cys Cys Asn Pro Ala Cys Thr Gly
Cys

Cys Cys Thr Leu Cys Cys Asn Pro Ala Cys Thr Gly
Cys

Cys Cys Gly Leu Cys Cys Asn Pro Ala Cys Thr Gly
Cys

Cys Cys Ser Leu Cys Cys Asn Pro Ala Cys Thr Gly
Cys

Cys Cys Thr Leu Cys Cys Asn Pro Ala Cys Thr Gly
Cys

Cys Cys Cys Leu Cys Cys Asn Pro Ala Cys Thr Gly
Cys

Cys Cys Asn Leu Cys Cys Asn Pro Ala Cys Thr Gly
Cys

Cys Cys Gln Leu Cys Cys Asn Pro Ala Cys Thr Gly
Cys

Cys Cys Tyr Leu Cys Cys Asn Pro Ala Cys Thr Gly
Cys

Cys Cys Asp Leu Cys Cys Asn Pro Ala Cys Thr Gly
Cys

Cys Cys Lys Leu Cys Cys Asn Pro Ala Cys Thr Gly
Cys

Cys Cys Arg Leu Cys Cys Asn Pro Ala Cys Thr Gly
Cys

Cys Cys His Leu Cys Cys Asn Pro Ala Cys Thr Gly
Cys

Cys Cys Ala Tyr Cys Cys Asn Pro Ala Cys Thr Gly
Cys Tyr

Cys Cys Val Tyr Cys Cys Asn Pro Ala Cys Thr Gly
Cys Tyr

Cys Cys Leu Tyr Cys Cys Asn Pro Ala Cys Thr Gly
Cys Tyr

-continued

Cys Cys Ile Tyr Cys Cys Asn Pro Ala Cys Thr Gly
Cys Tyr

Cys Cys Met Tyr Cys Cys Asn Pro Ala Cys Thr Gly
Cys Tyr

Cys Cys Phe Tyr Cys Cys Asn Pro Ala Cys Thr Gly
Cys Tyr

Cys Cys Trp Tyr Cys Cys Asn Pro Ala Cys Thr Gly
Cys Tyr

Cys Cys Gly Tyr Cys Cys Asn Pro Ala Cys Thr Gly
Cys Tyr

Cys Cys Ser Tyr Cys Cys Asn Pro Ala Cys Thr Gly
Cys Tyr

Cys Cys Thr Tyr Cys Cys Asn Pro Ala Cys Thr Gly
Cys Tyr

Cys Cys Cys Tyr Cys Cys Asn Pro Ala Cys Thr Gly
Cys Tyr

Cys Cys Asn Tyr Cys Cys Asn Pro Ala Cys Thr Gly
Cys Tyr

Cys Cys Gln Tyr Cys Cys Asn Pro Ala Cys Thr Gly
Cys Tyr

Cys Cys Tyr Tyr Cys Cys Asn Pro Ala Cys Thr Gly
Cys Tyr

Cys Cys Asp Tyr Cys Cys Asn Pro Ala Cys Thr Gly
Cys Tyr

Cys Cys Lys Tyr Cys Cys Asn Pro Ala Cys Thr Gly
Cys Tyr

Cys Cys Arg Tyr Cys Cys Asn Pro Ala Cys Thr Gly
Cys Tyr

Cys Cys His Tyr Cys Cys Asn Pro Ala Cys Thr Gly
Cys Tyr

Cys Cys Ala Tyr Cys Cys Asn Pro Ala Cys Thr Gly
Cys

Cys Cys Val Tyr Cys Cys Asn Pro Ala Cys Thr Gly
Cys

Cys Cys Leu Tyr Cys Cys Asn Pro Ala Cys Thr Gly
Cys

Cys Cys Ile Tyr Cys Cys Asn Pro Ala Cys Thr Gly
Cys

Cys Cys Met Tyr Cys Cys Asn Pro Ala Cys Thr Gly
Cys

-continued

Cys Cys Phe Tyr Cys Cys Asn Pro Ala Cys Thr Gly
Cys

Cys Cys Trp Tyr Cys Cys Asn Pro Ala Cys Thr Gly
Cys

Cys Cys Gly Tyr Cys Cys Asn Pro Ala Cys Thr Gly
Cys

Cys Cys Ser Tyr Cys Cys Asn Pro Ala Cys Thr Gly
Cys

Cys Cys Thr Tyr Cys Cys Asn Pro Ala Cys Thr Gly
Cys

Cys Cys Cys Tyr Cys Cys Asn Pro Ala Cys Thr Gly
Cys

Cys Cys Asn Tyr Cys Cys Asn Pro Ala Cys Thr Gly
Cys

Cys Cys Gln Tyr Cys Cys Asn Pro Ala Cys Thr Gly
Cys

Cys Cys Tyr Tyr Cys Cys Asn Pro Ala Cys Thr Gly
Cys

Cys Cys Asp Tyr Cys Cys Asn Pro Ala Cys Thr Gly
Cys

Cys Cys Lys Tyr Cys Cys Asn Pro Ala Cys Thr Gly
Cys

Cys Cys Arg Tyr Cys Cys Asn Pro Ala Cys Thr Gly
Cys

Cys Cys His Tyr Cys Cys Asn Pro Ala Cys Thr Gly
Cys

Cys Cys Glu Phe Cys Cys Ala Pro Ala Cys Thr Gly
Cys Tyr

Cys Cys Glu Phe Cys Cys Val Pro Ala Cys Thr Gly
Cys Tyr

Cys Cys Glu Phe Cys Cys Leu Pro Ala Cys Thr Gly
Cys Tyr

Cys Cys Glu Phe Cys Cys Ile Pro Ala Cys Thr Gly
Cys Tyr

Cys Cys Glu Phe Cys Cys Pro Pro Ala Cys Thr Gly
Cys Tyr

Cys Cys Glu Phe Cys Cys Met Pro Ala Cys Thr Gly
Cys Tyr

Cys Cys Glu Phe Cys Cys Phe Pro Ala Cys Thr Gly
Cys Tyr

Cys Cys Glu Phe Cys Cys Trp Pro Ala Cys Thr Gly
Cys Tyr

Cys Cys Glu Phe Cys Cys Gly Pro Ala Cys Thr Gly
Cys Tyr

Cys Cys Glu Phe Cys Cys Ser Pro Ala Cys Thr Gly
Cys Tyr

Cys Cys Glu Phe Cys Cys Thr Pro Ala Cys Thr Gly
Cys Tyr

Cys Cys Glu Phe Cys Cys Cys Pro Ala Cys Thr Gly
Cys Tyr

Cys Cys Glu Phe Cys Cys Gln Pro Ala Cys Thr Gly
Cys Tyr

Cys Cys Glu Phe Cys Cys Tyr Pro Ala Cys Thr Gly
Cys Tyr

Cys Cys Glu Phe Cys Cys Asp Pro Ala Cys Thr Gly
Cys Tyr

Cys Cys Glu Phe Cys Cys Glu Pro Ala Cys Thr Gly
Cys Tyr

Cys Cys Glu Phe Cys Cys Lys Pro Ala Cys Thr Gly
Cys Tyr

Cys Cys Glu Phe Cys Cys Arg Pro Ala Cys Thr Gly
Cys Tyr

Cys Cys Glu Phe Cys Cys His Pro Ala Cys Thr Gly
Cys Tyr

Cys Cys Glu Phe Cys Cys Ala Pro Ala Cys Thr Gly
Cys

Cys Cys Glu Phe Cys Cys Val Pro Ala Cys Thr Gly
Cys

Cys Cys Glu Phe Cys Cys Leu Pro Ala Cys Thr Gly
Cys

Cys Cys Glu Phe Cys Cys Ile Pro Ala Cys Thr Gly
Cys

Cys Cys Glu Phe Cys Cys Pro Pro Ala Cys Thr Gly
Cys

Cys Cys Glu Phe Cys Cys Met Pro Ala Cys Thr Gly
Cys

Cys Cys Glu Phe Cys Cys Phe Pro Ala Cys Thr Gly
Cys

Cys Cys Glu Phe Cys Cys Trp Pro Ala Cys Thr Gly
Cys

-continued

Cys Cys Glu Phe Cys Cys Gly Pro Ala Cys Thr Gly
Cys

Cys Cys Glu Phe Cys Cys Ser Pro Ala Cys Thr Gly
Cys

Cys Cys Glu Phe Cys Cys Thr Pro Ala Cys Thr Gly
Cys

Cys Cys Glu Phe Cys Cys Cys Pro Ala Cys Thr Gly
Cys

Cys Cys Glu Phe Cys Cys Gln Pro Ala Cys Thr Gly
Cys

Cys Cys Glu Phe Cys Cys Tyr Pro Ala Cys Thr Gly
Cys

Cys Cys Glu Phe Cys Cys Asp Pro Ala Cys Thr Gly
Cys

Cys Cys Glu Phe Cys Cys Glu Pro Ala Cys Thr Gly
Cys

Cys Cys Glu Phe Cys Cys Lys Pro Ala Cys Thr Gly
Cys

Cys Cys Glu Phe Cys Cys Arg Pro Ala Cys Thr Gly
Cys

Cys Cys Glu Phe Cys Cys His Pro Ala Cys Thr Gly
Cys

Cys Cys Glu Trp Cys Cys Ala Pro Ala Cys Thr Gly
Cys Tyr

Cys Cys Glu Trp Cys Cys Val Pro Ala Cys Thr Gly
Cys Tyr

Cys Cys Glu Trp Cys Cys Leu Pro Ala Cys Thr Gly
Cys Tyr

Cys Cys Glu Trp Cys Cys Ile Pro Ala Cys Thr Gly
Cys Tyr

Cys Cys Glu Trp Cys Cys Pro Pro Ala Cys Thr Gly
Cys Tyr

Cys Cys Glu Trp Cys Cys Met Pro Ala Cys Thr Gly
Cys Tyr

Cys Cys Glu Trp Cys Cys Phe Pro Ala Cys Thr Gly
Cys Tyr

Cys Cys Glu Trp Cys Cys Trp Pro Ala Cys Thr Gly
Cys Tyr

Cys Cys Glu Trp Cys Cys Gly Pro Ala Cys Thr Gly
Cys Tyr

-continued

Cys Cys Glu Trp Cys Cys Ser Pro Ala Cys Thr Gly
Cys Tyr

Cys Cys Glu Trp Cys Cys Thr Pro Ala Cys Thr Gly
Cys Tyr

Cys Cys Glu Trp Cys Cys Cys Pro Ala Cys Thr Gly
Cys Tyr

Cys Cys Glu Trp Cys Cys Gln Pro Ala Cys Thr Gly
Cys Tyr

Cys Cys Glu Trp Cys Cys Tyr Pro Ala Cys Thr Gly
Cys Tyr

Cys Cys Glu Trp Cys Cys Asp Pro Ala Cys Thr Gly
Cys Tyr

Cys Cys Glu Trp Cys Cys Glu Pro Ala Cys Thr Gly
Cys Tyr

Cys Cys Glu Trp Cys Cys Lys Pro Ala Cys Thr Gly
Cys Tyr

Cys Cys Glu Trp Cys Cys Arg Pro Ala Cys Thr Gly
Cys Tyr

Cys Cys Glu Trp Cys Cys His Pro Ala Cys Thr Gly
Cys Tyr

Cys Cys Glu Trp Cys Cys Ala Pro Ala Cys Thr Gly
Cys

Cys Cys Glu Trp Cys Cys Val Pro Ala Cys Thr Gly
Cys

Cys Cys Glu Trp Cys Cys Leu Pro Ala Cys Thr Gly
Cys

Cys Cys Glu Trp Cys Cys Ile Pro Ala Cys Thr Gly
Cys

Cys Cys Glu Trp Cys Cys Pro Pro Ala Cys Thr Gly
Cys

Cys Cys Glu Trp Cys Cys Met Pro Ala Cys Thr Gly
Cys

Cys Cys Glu Trp Cys Cys Phe Pro Ala Cys Thr Gly
Cys

Cys Cys Glu Trp Cys Cys Trp Pro Ala Cys Thr Gly
Cys

Cys Cys Glu Trp Cys Cys Gly Pro Ala Cys Thr Gly
Cys

Cys Cys Glu Trp Cys Cys Ser Pro Ala Cys Thr Gly
Cys

-continued

Cys Cys Glu Trp Cys Cys Thr Pro Ala Cys Thr Gly
Cys

Cys Cys Glu Trp Cys Cys Cys Pro Ala Cys Thr Gly
Cys

Cys Cys Glu Trp Cys Cys Gln Pro Ala Cys Thr Gly
Cys

Cys Cys Glu Trp Cys Cys Tyr Pro Ala Cys Thr Gly
Cys

Cys Cys Glu Trp Cys Cys Asp Pro Ala Cys Thr Gly
Cys

Cys Cys Glu Trp Cys Cys Glu Pro Ala Cys Thr Gly
Cys

Cys Cys Glu Trp Cys Cys Lys Pro Ala Cys Thr Gly
Cys

Cys Cys Glu Trp Cys Cys Arg Pro Ala Cys Thr Gly
Cys

Cys Cys Glu Trp Cys Cys His Pro Ala Cys Thr Gly
Cys

Cys Cys Glu Trp Cys Cys Asn Pro Ala Cys Thr Gly
Cys Ala

Cys Cys Glu Trp Cys Cys Asn Pro Ala Cys Thr Gly
Cys Val

Cys Cys Glu Trp Cys Cys Asn Pro Ala Cys Thr Gly
Cys Leu

Cys Cys Glu Trp Cys Cys Asn Pro Ala Cys Thr Gly
Cys Ile

Cys Cys Glu Trp Cys Cys Asn Pro Ala Cys Thr Gly
Cys Pro

Cys Cys Glu Trp Cys Cys Asn Pro Ala Cys Thr Gly
Cys Met

Cys Cys Glu Trp Cys Cys Asn Pro Ala Cys Thr Gly
Cys Phe

Cys Cys Glu Trp Cys Cys Asn Pro Ala Cys Thr Gly
Cys Trp

Cys Cys Glu Trp Cys Cys Asn Pro Ala Cys Thr Gly
Cys Gly

Cys Cys Glu Trp Cys Cys Asn Pro Ala Cys Thr Gly
Cys Ser

Cys Cys Glu Trp Cys Cys Asn Pro Ala Cys Thr Gly
Cys Thr

-continued

Cys Cys Glu Trp Cys Cys Asn Pro Ala Cys Thr Gly
Cys Cys

Cys Cys Glu Trp Cys Cys Asn Pro Ala Cys Thr Gly
Cys Asn

Cys Cys Glu Trp Cys Cys Asn Pro Ala Cys Thr Gly
Cys Gln

Cys Cys Glu Trp Cys Cys Asn Pro Ala Cys Thr Gly
Cys Asp

Cys Cys Glu Trp Cys Cys Asn Pro Ala Cys Thr Gly
Cys Glu

Cys Cys Glu Trp Cys Cys Asn Pro Ala Cys Thr Gly
Cys Lys

Cys Cys Glu Trp Cys Cys Asn Pro Ala Cys Thr Gly
Cys Arg

Cys Cys Glu Trp Cys Cys Asn Pro Ala Cys Thr Gly
Cys His

Cys Cys Glu Phe Cys Cys Asn Pro Ala Cys Thr Gly
Cys Ala

Cys Cys Glu Phe Cys Cys Asn Pro Ala Cys Thr Gly
Cys Val

Cys Cys Glu Phe Cys Cys Asn Pro Ala Cys Thr Gly
Cys Leu

Cys Cys Glu Phe Cys Cys Asn Pro Ala Cys Thr Gly
Cys Ile

Cys Cys Glu Phe Cys Cys Asn Pro Ala Cys Thr Gly
Cys Pro

Cys Cys Glu Phe Cys Cys Asn Pro Ala Cys Thr Gly
Cys Met

Cys Cys Glu Phe Cys Cys Asn Pro Ala Cys Thr Gly
Cys Phe

Cys Cys Glu Phe Cys Cys Asn Pro Ala Cys Thr Gly
Cys Trp

Cys Cys Glu Phe Cys Cys Asn Pro Ala Cys Thr Gly
Cys Gly

Cys Cys Glu Phe Cys Cys Asn Pro Ala Cys Thr Gly
Cys Ser

Cys Cys Glu Phe Cys Cys Asn Pro Ala Cys Thr Gly
Cys Thr

Cys Cys Glu Phe Cys Cys Asn Pro Ala Cys Thr Gly
Cys Cys

Cys Cys Glu Phe Cys Cys Asn Pro Ala Cys Thr Gly
Cys Asn

Cys Cys Glu Phe Cys Cys Asn Pro Ala Cys Thr Gly
Cys Gln

Cys Cys Glu Phe Cys Cys Asn Pro Ala Cys Thr Gly
Cys Asp

Cys Cys Glu Phe Cys Cys Asn Pro Ala Cys Thr Gly
Cys Glu

Cys Cys Glu Phe Cys Cys Asn Pro Ala Cys Thr Gly
Cys Lys

Cys Cys Glu Phe Cys Cys Asn Pro Ala Cys Thr Gly
Cys Arg

Cys Cys Glu Phe Cys Cys Asn Pro Ala Cys Thr Gly
Cys His

Cys Cys Ala Phe Cys Cys Asn Pro Ala Cys Thr Gly
Cys Tyr

Cys Cys Val Phe Cys Cys Asn Pro Ala Cys Thr Gly
Cys Tyr

Cys Cys Leu Phe Cys Cys Asn Pro Ala Cys Thr Gly
Cys Tyr

Cys Cys Ile Phe Cys Cys Asn Pro Ala Cys Thr Gly
Cys Tyr

Cys Cys Met Phe Cys Cys Asn Pro Ala Cys Thr Gly
Cys Tyr

Cys Cys Phe Phe Cys Cys Asn Pro Ala Cys Thr Gly
Cys Tyr

Cys Cys Trp Phe Cys Cys Asn Pro Ala Cys Thr Gly
Cys Tyr

Cys Cys Gly Phe Cys Cys Asn Pro Ala Cys Thr Gly
Cys Tyr

Cys Cys Ser Phe Cys Cys Asn Pro Ala Cys Thr Gly
Cys Tyr

Cys Cys Thr Phe Cys Cys Asn Pro Ala Cys Thr Gly
Cys Tyr

Cys Cys Cys Phe Cys Cys Asn Pro Ala Cys Thr Gly
Cys Tyr

Cys Cys Asn Phe Cys Cys Asn Pro Ala Cys Thr Gly
Cys Tyr

Cys Cys Gln Phe Cys Cys Asn Pro Ala Cys Thr Gly
Cys Tyr

Cys Cys Tyr Phe Cys Cys Asn Pro Ala Cys Thr Gly
Cys Tyr

Cys Cys Asp Phe Cys Cys Asn Pro Ala Cys Thr Gly
Cys Tyr

Cys Cys Lys Phe Cys Cys Asn Pro Ala Cys Thr Gly
Cys Tyr

Cys Cys Arg Phe Cys Cys Asn Pro Ala Cys Thr Gly
Cys Tyr

Cys Cys His Phe Cys Cys Asn Pro Ala Cys Thr Gly
Cys Tyr

Cys Cys Ala Phe Cys Cys Asn Pro Ala Cys Thr Gly
Cys

Cys Cys Val Phe Cys Cys Asn Pro Ala Cys Thr Gly
Cys

Cys Cys Leu Phe Cys Cys Asn Pro Ala Cys Thr Gly
Cys

Cys Cys Ile Phe Cys Cys Asn Pro Ala Cys Thr Gly
Cys

Cys Cys Met Phe Cys Cys Asn Pro Ala Cys Thr Gly
Cys

Cys Cys Phe Phe Cys Cys Asn Pro Ala Cys Thr Gly
Cys

Cys Cys Trp Phe Cys Cys Asn Pro Ala Cys Thr Gly
Cys

Cys Cys Gly Phe Cys Cys Asn Pro Ala Cys Thr Gly
Cys

Cys Cys Ser Phe Cys Cys Asn Pro Ala Cys Thr Gly
Cys

Cys Cys Thr Phe Cys Cys Asn Pro Ala Cys Thr Gly
Cys

Cys Cys Cys Phe Cys Cys Asn Pro Ala Cys Thr Gly
Cys

Cys Cys Asn Phe Cys Cys Asn Pro Ala Cys Thr Gly
Cys

Cys Cys Gln Phe Cys Cys Asn Pro Ala Cys Thr Gly
Cys

Cys Cys Tyr Phe Cys Cys Asn Pro Ala Cys Thr Gly
Cys

Cys Cys Asp Phe Cys Cys Asn Pro Ala Cys Thr Gly
Cys

-continued

Cys Cys Lys Phe Cys Cys Asn Pro Ala Cys Thr Gly Cys

Cys Cys Arg Phe Cys Cys Asn Pro Ala Cys Thr Gly Cys

Cys Cys His Phe Cys Cys Asn Pro Ala Cys Thr Gly Cys

Cys Cys Ala Trp Cys Cys Asn Pro Ala Cys Thr Gly Cys Tyr

Cys Cys Val Trp Cys Cys Asn Pro Ala Cys Thr Gly Cys Tyr

Cys Cys Leu Trp Cys Cys Asn Pro Ala Cys Thr Gly Cys Tyr

Cys Cys Ile Trp Cys Cys Asn Pro Ala Cys Thr Gly Cys Tyr

Cys Cys Met Trp Cys Cys Asn Pro Ala Cys Thr Gly Cys Tyr

Cys Cys Phe Trp Cys Cys Asn Pro Ala Cys Thr Gly Cys Tyr

Cys Cys Trp Trp Cys Cys Asn Pro Ala Cys Thr Gly Cys Tyr

Cys Cys Gly Trp Cys Cys Asn Pro Ala Cys Thr Gly Cys Tyr

Cys Cys Ser Trp Cys Cys Asn Pro Ala Cys Thr Gly Cys Tyr

Cys Cys Thr Trp Cys Cys Asn Pro Ala Cys Thr Gly Cys Tyr

Cys Cys Cys Trp Cys Cys Asn Pro Ala Cys Thr Gly Cys Tyr

Cys Cys Asn Trp Cys Cys Asn Pro Ala Cys Thr Gly Cys Tyr

Cys Cys Gln Trp Cys Cys Asn Pro Ala Cys Thr Gly Cys Tyr

Cys Cys Tyr Trp Cys Cys Asn Pro Ala Cys Thr Gly Cys Tyr

Cys Cys Asp Trp Cys Cys Asn Pro Ala Cys Thr Gly Cys Tyr

Cys Cys Lys Trp Cys Cys Asn Pro Ala Cys Thr Gly Cys Tyr

Cys Cys Arg Trp Cys Cys Asn Pro Ala Cys Thr Gly Cys Tyr

-continued

Cys Cys His Trp Cys Cys Asn Pro Ala Cys Thr Gly Cys Tyr

Cys Cys Ala Trp Cys Cys Asn Pro Ala Cys Thr Gly Cys

Cys Cys Val Trp Cys Cys Asn Pro Ala Cys Thr Gly Cys

Cys Cys Leu Trp Cys Cys Asn Pro Ala Cys Thr Gly Cys

Cys Cys Ile Trp Cys Cys Asn Pro Ala Cys Thr Gly Cys

Cys Cys Met Trp Cys Cys Asn Pro Ala Cys Thr Gly Cys

Cys Cys Phe Trp Cys Cys Asn Pro Ala Cys Thr Gly Cys

Cys Cys Trp Trp Cys Cys Asn Pro Ala Cys Thr Gly Cys

Cys Cys Gly Trp Cys Cys Asn Pro Ala Cys Thr Gly Cys

Cys Cys Ser Trp Cys Cys Asn Pro Ala Cys Thr Gly Cys

Cys Cys Thr Trp Cys Cys Asn Pro Ala Cys Thr Gly Cys

Cys Cys Cys Trp Cys Cys Asn Pro Ala Cys Thr Gly Cys

Cys Cys Asn Trp Cys Cys Asn Pro Ala Cys Thr Gly Cys

Cys Cys Gln Trp Cys Cys Asn Pro Ala Cys Thr Gly Cys

Cys Cys Tyr Trp Cys Cys Asn Pro Ala Cys Thr Gly Cys

Cys Cys Asp Trp Cys Cys Asn Pro Ala Cys Thr Gly Cys

Cys Cys Lys Trp Cys Cys Asn Pro Ala Cys Thr Gly Cys

Cys Cys Arg Trp Cys Cys Asn Pro Ala Cys Thr Gly Cys

Cys Cys His Trp Cys Cys Asn Pro Ala Cys Thr Gly

The invention also features deletion variants of any of the peptides described herein in which one, two, three or four amino acids (or non-natural amino acids or natural or non-natural amino acid analogs), other than a Cys (or an amino acid substituted for Cys, e.g, an amino acid capable of forming a covalent bond to another amino acid), are deleted.

Where two (or more) amino acids are deleted and the peptide comprises the sequence: $Cys_a\ Cys_b\ Xaa\ Xaa\ Cys_c\ Cys_d\ Xaa\ Xaa\ Xaa\ Cys_e\ Xaa\ Xaa\ Cys_f$, in some embodiments two or more deletions can be located between $Cys_b$ and $Cys_c$ and/or between $Cys_d$ and $Cys_e$ and/or between $Cys_e$ and $Cys_f$. However, in other embodiments there is at most one deletion between each of $Cys_b$ and $Cys_c$ or between $Cys_d$ and $Cys_e$ or between $Cys_e$ and $Cys_f$. Thus, the invention includes any of the peptides described herein comprising the sequence $Cys_a\ Cys_b\ Xaa\ Xaa\ Cys_c\ Cys_d\ Xaa\ Xaa\ Xaa\ Cys_e\ Xaa\ Xaa\ Cys_f$ wherein: a) one amino acid between $Cys_b$ and $Cys_c$ is deleted; b) one amino acid between $Cys_d$ and $Cys_e$ is deleted; c) one amino acid between $Cys_e$ and $Cys_f$ is deleted; d) one amino acid between $Cys_b$ and $Cys_c$ is deleted and one amino acid between $Cys_d$ and $Cys_e$ is deleted; e) one amino acid between $Cys_d$ and $Cys_e$ is deleted and one amino acid between $Cys_e$ and $Cys_f$ is deleted; f) one amino acid between $Cys_b$ and $Cys_c$ is deleted and one amino acid between $Cys_e$ and $Cys_f$ is deleted or g) one amino acid between $Cys_b$ and $Cys_c$ is deleted, one amino acid between $Cys_d$ and $Cys_e$ is deleted and one amino acid between $Cys_e$ and $Cys_f$ is deleted. In certain embodiments, the various deletion variants are peptides that bind to and/or activate the GC-C receptor. In various embodiments, the various deletion variants are peptides that increase cGMP levels.

Deletion variants of Cys Cys Glu Tyr Cys Cys Asn Pro Ala Cys Thr Gly Cys Tyr (SEQ ID NO:3) include the peptides listed in FIG. 11. In these deletion variants, any of the amino acids can be deleted and there can be one, two, three or four amino acids deleted other than Cys.

The invention also features insertion variants of any of the peptides described herein in which one, two, three or four amino acids (e.g., Gly or Ala) are inserted before or after any amino acid in the peptide. In some embodiments no more than one amino acid is inserted between two Cys. For example, where two or more amino acids are inserted and the peptide comprises the sequence $Cys_a\ Cys_b\ Xaa\ Xaa\ Cys_c\ Cys_d\ Xaa\ Xaa\ Xaa\ Cys_e\ Xaa\ Xaa\ Cys_f$, in some embodiments two or more insertions can be located between $Cys_b$ and $Cys_c$ or between $Cys_d$ and $Cys_e$ or between $Cys_e$ and $Cys_f$. However, in other embodiments no more than one insertion is located between $Cys_b$ and $Cys_c$ or between $Cys_d$ and $Cys_e$ or between $Cys_e$ and $Cys_f$. Thus, the invention features any of the peptides described herein comprising the sequence $Cys_a\ Cys_b\ Xaa\ Xaa\ Cys_c\ Cys_d\ Xaa\ Xaa\ Xaa\ Cys_e\ Xaa\ Xaa\ Cys_f$ wherein: a) one amino acid is inserted between $Cys_b$ and $Cys_c$; b) one amino acid is inserted between $Cys_d$ and $Cys_e$; c) one amino acid is inserted between $Cys_e$ and $Cys_f$; d) one amino acid is inserted between $Cys_b$ and $Cys_c$ and one amino acid is inserted between $Cys_d$ and $Cys_e$; e) one amino acid is inserted between $Cys_d$ and $Cys_e$ and one amino acid is inserted between $Cys_e$ and $Cys_f$; f) one amino acid is inserted between $Cys_b$ and $Cys_c$ and one amino acid is inserted between $Cys_e$ and $Cys_f$; or g) one amino acid is inserted between $Cys_b$ and $Cys_c$, one amino acid is inserted between $Cys_d$ and $Cys_e$ and one amino acid is inserted between $Cys_e$ and $Cys_f$. In addition, one or more amino acids can be inserted preceding $Cys_a$ and/or one or more amino acids can be inserted following $Cys_f$.

In various embodiments, the various insertion variants are peptides that bind to and/or activate the GC-C receptor. In various embodiments, the various insertion variants are peptides that increase cGMP levels.

Insertion variants of Cys Cys Glu Tyr Cys Cys Asn Pro Ala Cys Thr Gly Cys Tyr (SEQ ID NO:3) include those in which up to four amino acids (i.e., 0, 1, 2, 3 or 4) can be inserted after each amino acid. Thus, the invention includes peptides having the sequence: Cys $Xaa_{(0-4)}$ Cys $Xaa_{(0-4)}$ Glu $Xaa_{(0-4)}$ Tyr $Xaa_{(0-4)}$ Cys $Xaa_{(0-4)}$ Cys $Xaa_{(0-4)}$ Asn $Xaa_{(0-4)}$ Pro $Xaa_{(0-4)}$ Ala $Xaa_{(0-4)}$ Cys $Xaa_{(0-4)}$ Thr $Xaa_{(0-4)}$ Gly $Xaa_{(0-4)}$ Cys $Xaa_{(0-4)}$ Tyr $Xaa_{(0-4)}$) (SEQ ID NO:2084). The inserted amino acids can be any amino acid or amino acid analog (natural or non-natural) and can be the same or different. In certain embodiments the inserted amino acids are all Gly or all Ala or a combination of Gly and Ala.

FIG. 12 depicts insertion variants of the peptide having the sequence: Cys Cys Glu Tyr Cys Cys Asn Pro Ala Cys Thr Gly Cys Tyr (SEQ ID NO:3).

The invention also features variants of peptides having the sequence $Xaa_1\ Xaa_2\ Xaa_3\ Xaa_4\ Xaa_5 Cys_6\ Cys_7\ Xaa_8\ Xaa_9\ Cys_{10}\ Cys_{11}\ Xaa_{12}\ Xaa_{13}\ Xaa_{14}\ Cys_{15}\ Xaa_{16}\ Xaa_{17}\ Cys_{18}\ Xaa_{19}\ Xaa_{20}\ Xaa_{21}$ (SEQ ID NO:1), e.g., variants of Cys Cys Glu Tyr Cys Cys Asn Pro Ala Cys Thr Gly Cys Tyr (SEQ ID NO:3), in which up to four amino acids are deleted and/or up to four amino acids are inserted. The insertions and deletions can be between $Cys_6$ and $Cys_{18}$ in SEQ ID NO:1 or they can be amino terminal to $Cys_6$ and/or carboxy terminal to $Cys_{18}$ in SEQ ID NO:1.

The invention also features peptides which may include one or more of the peptide modifications, one or more non-natural amino acid or amino acid analogs, one or more of the disulfide bond alternatives or one or more of the alternative peptide bonds described herein.

The peptides of the invention can be present with a counterion. Useful counterions include salts of: acetate, benzenesulfonate, benzoate, calcium edetate, camsylate, carbonate, citrate, edetate (EDTA), edisylate, embonate, esylate, fumarate, gluceptate, gluconate, glutamate, glycollylarsanilate, hexylresorcinate, iodide, bromide, chloride, hydroxynaphthoate, isethionate, lactate, lactobionate, estolate, maleate, malate, mandelate, mesylate, mucate, napsylate, nitrate, pantothenate, phosphate, salicylate, stearate, succinate, sulfate, tartarate, theoclate, acetamidobenzoate, adipate, alginate, aminosalicylate, anhydromethylenecitrate, ascorbate, aspartate, camphorate, caprate, caproate, caprylate, cinnamate, cyclamate, dichloroacetate, formate, gentisate, glucuronate, glycerophosphate, glycolate, hippurate, fluoride, malonate, napadisylate, nicotinate, oleate, orotate, oxalate, oxoglutarate, palmitate, pectinate, pectinate polymer, phenylethylbarbiturate, picrate, propionate, pidolate, sebacate, rhodanide, tosylate, and tannate.

The peptides and agonist of the intestinal guanylate cyclase (GC-C) receptor can be used to treat constipation or decreased intestinal motility, slow digestion or slow stomach emptying. The peptides can be used to relieve one or more symptoms of IBS (bloating, pain, constipation), GERD (acid reflux into the esophagus), duodenogastric reflux, functional dyspepsia, or gastroparesis (nausea, vomiting, bloating, delayed gastric emptying) and other disorders described herein.

The details of one or more embodiments of the invention are set forth in the accompanying description. All of the publications, patents and patent applications are hereby incorporated by reference.

FIGURES

FIG. 3B depicts the effect of synthetic SEQ ID NO:3 peptide and Zelnorm® in an acute murine gastrointestinal transit model.

FIG. 4C depicts the effect of SEQ ID NO:3 peptide in a chronic murine gastrointestinal transit model.

FIG. 5B depicts the effects of SEQ ID NO:3 and Zelnorm® in a mouse intestinal secretion model.

FIGS. 6A and 6B depict the effects of SEQ ID NO:4, SEQ ID NO:3 and SEQ ID NO:5 peptides in a mouse intestinal secretion model.

FIGS. 10A and 10B show bioavailability data for IV and orally administered SEQ ID NO:3 as detected by an ELISA assay and LCMS.

FIG. 11 depicts deletion variants of a peptide having the sequence of SEQ ID NO:3.

FIG. 12 depicts insertion variants of a peptide having the sequence of SEQ ID NO:3.

DETAILED DESCRIPTION

Figure 1A:
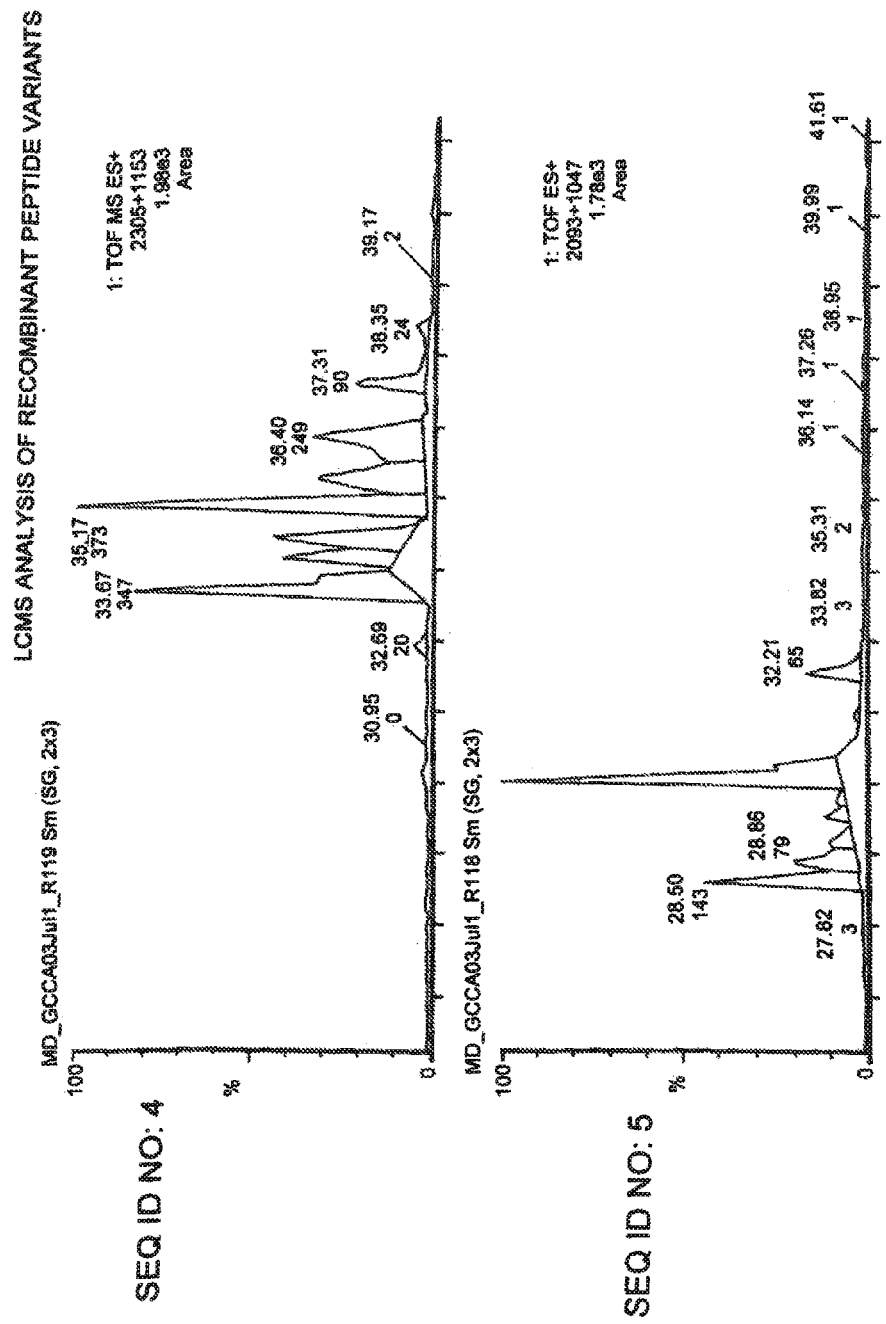
FIG. 1A depicts the results of LCMS analysis of recombinant SEQ ID NO:4 peptide and SEQ ID NO:5 peptide.

The peptides of the invention bind to the intestinal guanylate cyclase (GC-C) receptor, a key regulator of fluid and electrolyte balance in the intestine. When stimulated, this receptor, which is located on the apical membrane of the intestinal epithelial surface, causes an increase in intestinal epithelial cyclic GMP (cGMP). This increase in cGMP is believed to cause a decrease in water and sodium absorption and an increase in chloride and potassium ion secretion, leading to changes in intestinal fluid and electrolyte transport and increased intestinal motility. The intestinal GC-C receptor possesses an extracellular ligand binding region, a transmembrane region, an intracellular protein kinase-like region and a cyclase catalytic domain. Proposed functions for the GC-C receptor are fluid and electrolyte homeostasis, the regulation of epithelial cell proliferation and the induction of apoptosis (Shalubhai 2002 Curr Opin Drug Dis Devel 5:261-268).

In addition to being expressed in the intestine by gastrointestinal epithelial cells, GC-C is expressed in extra-intestinal tissues including kidney, lung, pancreas, pituitary, adrenal, developing liver and gall bladder (reviewed in Vaandrager 2002 Mol Cell Biochem 230:73-83, Kulaksiz et al. 2004, Gastroenterology 126:732-740) and male and female reproductive tissues (reviewed in Vaandrager 2002 Mol Cell Biochem 230:73-83). This suggests that the GC-C receptor agonists can be used in the treatment of disorders outside the GI tract, for example, congestive heart failure and benign prostatic hyperplasia.

Ghrelin, a peptide hormone secreted by the stomach, is a key regulator of appetite in humans. Ghrelin expression levels are regulated by fasting and by gastric emptying (Kim et al. 2003 Neuroreprt 14:1317-20; Gualillo et al. 2003 FEBS Letts 552: 105-9). Thus, by increasing gastrointestinal motility, GC-C receptor agonists may also be used to regulate obesity.

In humans, the GC-C receptor is activated by guanylin (Gn) (U.S. Pat. No. 5,969,097), uroguanylin (Ugn) (U.S. Pat. No. 5,140,102) and lymphoguanylin (Forte et al. 1999 *Endocrinology* 140:1800-1806). Interestingly, these agents are 10-100 fold less potent than a class of bacterially derived peptides, termed ST (reviewed in Gianella 1995 J Lab Clin Med 125:173-181). ST peptides are considered super agonists of GC-C and are very resistant to proteolytic degradation.

ST peptide is capable of stimulating the enteric nervous system (Rolfe et al., 1994, J Physiolo 475: 531-537; Rolfe et al. 1999 Gut 44: 615-619; Nzegwu et al. 1996 Exp Physiol 81: 313-315). Also, cGMP has been reported to have antinociceptive effects in multiple animal models of pain (Lazaro Ibanez et al. 2001 Eur J Pharmacol 426: 39-44; Soares et al. 2001 British J Pharmacol 134: 127-131; Jain et al. 2001 Brain Res 909:170-178; Amarante et al. 2002 Eur J Pharmacol 454:19-23). Thus, GC-C agonists may have both an analgesic as well an anti-inflammatory effect.

In bacteria, ST peptides are derived from a preproprotein that generally has at least 70 amino acids. The pre and pro regions are cleaved as part of the secretion process, and the resulting mature protein, which generally includes fewer than 20 amino acids, is biologically active.

Among the known bacterial ST peptides are: *E. coli* ST Ib (Moseley et al. 1983 Infect. Immun. 39:1167) having the mature amino acid sequence Asn Ser Ser Asn Tyr Cys Cys Glu Leu Cys Cys Asn Pro Ala Cys Thr Gly Cys Tyr (SEQ ID NO:100); *E. coli* ST Ia (So and McCarthy 1980 Proc. Natl. Acad. Sci. USA 77:4011) having the mature amino acid sequence Asn Thr Phe Tyr Cys Cys Glu Leu Cys Cys Asn Pro Ala Cys Ala Gly Cys Tyr (SEQ ID NO:101); *E. coli* ST I* (Chan and Giannella 1981 J. Biol. Chem. 256:7744) having the mature amino acid sequence Asn Thr Phe Tyr Cys Cys Glu Leu Cys Cys Tyr Pro Ala Cys Ala Gly Cys Asn (SEQ ID NO:102); *C. freundii* ST peptide (Guarino et al. 1989b *Infect. Immun.* 57:649) having the mature amino acid sequence Asn Thr Phe Tyr Cys Cys Glu Leu Cys Cys Asn Pro Ala Cys Ala Gly Cys Tyr (SEQ ID NO:103); *Y. enterocolitica* ST peptides, Y-ST(Y-STa), Y-STb, and Y-STc (reviewed in Huang et al. 1997 Microb. Pathog. 22:89) having the following pro-form amino acid sequences: Gln Ala Cys Asp Pro Pro Ser Pro Pro Ala Glu Val Ser Ser Asp Trp Asp Cys Cys Asp Val Cys Cys Asn Pro Ala Cys Ala Gly Cys (SEQ ID NO:104) (as well as a Ser-7 to Leu-7 variant of Y-STa (SEQ ID NO:105), (Takao et al. 1985 Eur. J. Biochem. 152:199)); Lys Ala Cys Asp Thr Gln Thr Pro Ser Pro Ser Glu Glu Asn Asp Asp Trp Cys Cys Glu Val Cys Cys Asn Pro Ala Cys Ala Gly Cys (SEQ ID NO:106); Gln Glu Thr Ala Ser Gly Gln Val Gly Asp Val Ser Ser Ser Thr Ile Ala Thr Glu Val Ser Glu Ala Glu Cys Gly Thr Gln Ser Ala Thr Thr Gln Gly Glu Asn Asp Trp Asp Trp Cys Cys Glu Leu Cys Cys Asn Pro Ala Cys Phe Gly Cys (SEQ ID NO:107), respectively; *Y. kristensenii* ST peptide having the mature amino acid sequence Ser Asp Trp Cys Cys Glu Val Cys Cys Asn Pro Ala Cys Ala Gly Cys (SEQ ID NO:108); *V. cholerae* non-01 ST peptide (Takao et al. (1985) *FEBS lett.* 193:250) having the mature amino acid sequence Ile Asp Cys Cys Glu Ile Cys Cys Asn Pro Ala Cys Phe Gly Cys Leu Asn (SEQ ID NO:109); and *V. mimicus* ST peptide (Arita et al. 1991 FEMS Microbiol. Lett. 79:105) having the mature amino acid sequence Ile Asp Cys Cys Glu Ile Cys Cys Asn Pro Ala Cys Phe Gly Cys Leu Asn (SEQ ID NO:110). Table I below provides sequences of all or a portion of a number of mature ST peptides.

TABLE 1

| GenBank® Accession No. | GenBank® GI No. | Sequence | |
|---|---|---|---|
| QHECIB | 69638 | NSSNYCCELCCNPACTGCY | (SEQ ID NO: 100) |
| P01559 | 123711 | NTFYCCELCCNPACAGCY | (SEQ ID NO: 101) |
| AAA24653 | 147878 | NTFYCCELCCNPACAPCY | (SEQ ID NO: 111) |
| P01560 | 123707 | NTFYCCELCCYPACAGCN | (SEQ ID NO: 102) |
| AAA27561 | 295439 | IDCCEICCNPACFGCLN | (SEQ ID NO: 109) |
| P04429 | 123712 | IDCCEICCNPACFGCLN | (SEQ ID NO: 110) |
| S34671 | 421286 | IDCCEICCNPACF | (SEQ ID NO: 112) |
| CAA52209 | 395161 | IDCCEICCNPACFG | (SEQ ID NO: 113) |
| A54534 | 628844 | IDCCEICCNPACFGCLN | (SEQ ID NO: 114) |
| AAL02159 | 15592919 | IDRCEICCNPACFGCLN | (SEQ ID NO: 115) |
| AAA18472 | 487395 | DWDCCDVCCNPACAGC | (SEQ ID NO: 116) |
| S25659 | 282047 | DWDCCDVCCNPACAGC | (SEQ ID NO: 117) |
| P74977 | 3913874 | NDDWCCEVCCNPACAGC | (SEQ ID NO: 118) |
| BAA23656 | 2662339 | WDWCCELCCNPACFGC | (SEQ ID NO: 119) |
| P31518 | 399947 | SDWCCEVCCNPACAGC | (SEQ ID NO: 108) |

QACDPPSPPAEVSSDWDCCDVCCDPAC AGC
(SEQ ID NO: 120)

QACDPPSPPAEVSSDWDCCDVCCNPACAG C
(SEQ ID NO: 104)

KACDTQTPSPSEENDDTCCEVCCNPACAG C
(SEQ ID NO: 106)

QETASGQVGDVSSSTIATEVSEAECGTQSAT
TQGENDWDWCCELCCNPACFGC
(SEQ ID NO: 107)

MKKLMLAIFISVLSFPSFSQSTESLD
SSKEKITLETKKCDVVKNNSEKKSEN
MNNTFYCCELCCNPACAGCY
(SEQ ID NO: 121)

MKKSILFIFLSVLSFSPFAQDAKPVE
SSKEKITLESKKCNIAKKSNKSGPES
MNSSNYCCELCCNPACTGCY
(SEQ ID NO: 122)

MKKIVFVLVLMLSSFGAFGQETVSGQ
FSDALSTPITAEVYKQACDPPLPPAA
AEVSSDWDCCDVCCNPACAGC
(SEQ ID NO: 123)

GNLIDCCEICCNPACFGCLN
(SEQ ID NO: 2081)

TABLE 1-continued

| GenBank® Accession No. | GenBank® GI No. | Sequence |
|---|---|---|
| | | GNLIDRCEICCNPACFGCLN (SEQ ID NO: 2082) |
| | | PPAEVSSDWDCCDVCCNPACAGC (SEQ ID NO: 2083) |

The immature (including pre and pro regions) form of *E. coli* ST-1A (ST-P) protein has the sequence: mkklmlaifisvls-fpsfsqstesldsskekitletkkcdv-vknnsekksenmnntfyccelccnpacagcy (SEQ ID NO:121; see GenBank® Accession No. P01559 (gi:123711). The pre sequence extends from aa 1-19. The pro sequence extends from aa 20-54. The mature protein extends from 55-72. The immature (including pre and pro regions) form of *E. coli* ST-1B (ST-H) protein has the sequence: mkksilfiflsvlsfsp-faqdakpvesskekitleskkc-niakksnksgpesmnssnyccelccnpactgcy (SEQ ID NO:122; see GenBank® Accession No. P07965 (gi:3915589)). The immature (including pre and pro regions) form of *Y. enterocolitica* ST protein has the sequence: mkkivfvlvlmlssfgafgqetvsgqfs-dalstpitaevykqacdpplppaevssdwdccdvccnpacagc (SEQ ID NO:123; see GenBank® Accession No. 525659 (gi: 282047)).

The peptides of the invention, like the bacterial ST peptides, have six Cys residues. These six Cys residues form three disulfide bonds in the mature and active form of the peptide. If the six Cys residues are identified, from the amino to carboxy terminus of the peptide, as A, B, C, D, E, and F, then the disulfide bonds form as follows: A-D, B-E, and C-F. The formation of these bonds is thought to be important for GC-C receptor binding. Certain of the peptides of the invention include a potentially functional chymotrypsin cleavage site, e.g., a Trp, Tyr or Phe located between either Cys B and Cys D or between Cys E and Cys F. Cleavage at either chymotrypsin cleavage site may reduce or eliminates the ability of the peptide to bind to the GC-C receptor.

In the human body an inactive form of chymotrypsin, chymotrypsinogen is produced in the pancreas. When this inactive enzyme reaches the small intestine it is converted to active chymotrypsin by the excision of two di-peptides. Active chymotrypsin can potentially cleave peptides at the peptide bond on the carboxy-terminal side of Trp, Tyr or Phe. The presence of active chymotrypsin in the intestinal tract can potentially lead to cleavage of certain of the peptides of the invention having an appropriately positioned functional chymotrypsin cleavage site. It is expected that chymotrypsin cleavage will moderate the action of a peptide of the invention having an appropriately positioned chymotrypsin cleavage site as the peptide passes through the intestinal tract.

Trypsinogen, like chymotrypsin, is a serine protease that is produced in the pancreas and is present in the digestive tract. The active form, trypsin, will cleave peptides having a Lys or Arg. The presence of active trypsin in the intestinal tract can lead to cleavage of certain of the peptides of the invention having an appropriately positioned functional trypsin cleavage site. It is expected that chymotrypsin cleavage will moderate the action of a peptide of the invention having an appropriately positioned trypsin cleavage site as the peptide passes through the intestinal tract.

Many gastrointestinal disorders, including IBS, are associated with abdominal or visceral pain. Certain of the peptides of the invention include analgesic or antinociceptive tags such as the carboxy-terminal sequence AspPhe immediately following a Trp, Tyr or Phe that creates a functional chymotrypsin cleavage site or following Lys or Arg that creates a functional trypsin cleavage site. Chymotrypsin in the intestinal tract can potentially cleave such peptides immediately carboxy terminal to the Trp, Phe or Tyr residue, releasing the dipeptide, AspPhe. This dipeptide has been shown to have analgesic activity in animal models (Abdikkahi et al. 2001 Fundam Clin Pharmacol 15:117-23; Nikfar et al 1997, 29:583-6; Edmundson et al 1998 Clin Pharmacol Ther 63:580-93). In this manner such peptides can treat both pain and inflammation. Other analgesic peptides can be present at the amino or carboxy terminus of the peptide (e.g., following a functional cleavage site) including: endomorphin-1, endomorphin-2, nocistatin, dalargin, lupron, and substance P.

A number of the useful peptides are based on the core sequence: Cys Cys Glu Leu Cys Cys Asn Pro Ala Cys Thr Gly Cys Tyr (SEQ ID NO:6). To create a variant having a potentially functional chymotrypsin cleavage site capable of inactivating the peptide, either the Leu (underlined) or the Thr (underlined) can be replaced by Trp, Phe or Tyr or both the Leu and the Thr can be replaced by (independently) Trp, Phe or Tyr. To create a variant having an analgesic di-peptide, the core sequence is followed by Asp Phe. The carboxy terminal Tyr in the core sequence can allow the Asp Phe dipeptide to be released by chymotrypsin in the digestive tract. The core sequence can be optionally be preceded by Asn Ser Ser Asn Tyr or Asn.

Thus, useful variants based on the core sequence include:

(SEQ ID NO: 4)
Asn Ser Ser Asn Tyr Cys Cys Glu Leu Cys Cys Asn
Pro Ala Cys Thr Gly Cys Tyr (SEQ ID NO: 7)
Asn Ser Ser Asn Tyr Cys Cys Glu Leu Cys Cys Asn
Pro Ala Cys Trp Gly Cys Tyr (SEQ ID NO: 5)
Asn Ser Ser Asn Tyr Cys Cys Glu Tyr Cys Cys Asn
Pro Ala Cys Thr Gly Cys Tyr (SEQ ID NO: 6)
Cys Cys Glu Leu Cys Cys Asn Pro Ala Cys Thr Gly
Cys Tyr (SEQ ID NO: 8)
Cys Cys Glu Leu Cys Cys Asn Pro Ala Cys Trp Gly
Cys Tyr

-continued (SEQ ID NO: 3)
Cys Cys Glu Tyr Cys Cys Asn Pro Ala Cys Thr Gly
Cys Tyr (SEQ ID NO: 9)
Asn Cys Cys Glu Leu Cys Cys Asn Pro Ala Cys Thr
Gly Cys Tyr (SEQ ID NO: 10)
Asn Cys Cys Glu Leu Cys Cys Asn Pro Ala Cys Trp
Gly Cys Tyr (SEQ ID NO: 11)
Asn Cys Cys Glu Phe Cys Cys Asn Pro Ala Cys Thr
Gly Cys Tyr (SEQ ID NO: 12)
Asn Cys Cys Glu Tyr Cys Cys Asn Pro Ala Cys Thr
Gly Cys Tyr (SEQ ID NO: 13)
Asn Cys Cys Glu Trp Cys Cys Asn Pro Ala Cys Thr
Gly Cys Tyr (SEQ ID NO: 14)
Asn Cys Cys Glu Arg Cys Cys Asn Pro Ala Cys Thr
Gly Cys Tyr (SEQ ID NO: 15)
Asn Cys Cys Glu Lys Cys Cys Asn Pro Ala Cys Thr
Gly Cys Tyr (SEQ ID NO: 16)
Asn Ser Ser Asn Tyr Cys Cys Glu Leu Cys Cys Asn
Pro Ala Cys Thr Gly Cys Tyr Asp Phe (SEQ ID NO: 17)
Asn Ser Ser Asn Tyr Cys Cys Glu Leu Cys Cys Asn
Pro Ala Cys Trp Gly Cys Tyr Asp Phe (SEQ ID NO: 18)
Asn Ser Ser Asn Tyr Cys Cys Glu Phe Cys Cys Asn
Pro Ala Cys Thr Gly Cys Tyr Asp Phe (SEQ ID NO: 19)
Asn Ser Ser Asn Tyr Cys Cys Glu Tyr Cys Cys Asn
Pro Ala Cys Thr Gly Cys Tyr Asp Phe (SEQ ID NO: 20)
Asn Ser Ser Asn Tyr Cys Cys Glu Trp Cys Cys Asn
Pro Ala Cys Thr Gly Cys Tyr Asp Phe (SEQ ID NO: 21)
Asn Ser Ser Asn Tyr Cys Cys Glu Arg Cys Cys Asn
Pro Ala Cys Thr Gly Cys Tyr Asp Phe (SEQ ID NO: 22)
Asn Ser Ser Asn Tyr Cys Cys Glu Lys Cys Cys Asn
Pro Ala Cys Thr Gly Cys Tyr Asp Phe (SEQ ID NO: 23)
Cys Cys Glu Leu Cys Cys Asn Pro Ala Cys Thr Gly
Cys Tyr Asp Phe (SEQ ID NO: 24)
Cys Cys Glu Leu Cys Cys Asn Pro Ala Cys Trp Gly
Cys Tyr Asp Phe (SEQ ID NO: 25)
Cys Cys Glu Phe Cys Cys Asn Pro Ala Cys Thr Gly
Cys Tyr Asp Phe (SEQ ID NO: 26)
Cys Cys Glu Tyr Cys Cys Asn Pro Ala Cys Thr Gly
Cys Tyr Asp Phe (SEQ ID NO: 27)
Cys Cys Glu Trp Cys Cys Asn Pro Ala Cys Thr Gly
Cys Tyr Asp Phe (SEQ ID NO: 28)
Cys Cys Glu Arg Cys Cys Asn Pro Ala Cys Thr Gly
Cys Tyr Asp Phe (SEQ ID NO: 29)
Cys Cys Glu Lys Cys Cys Asn Pro Ala Cys Thr Gly
Cys Tyr Asp Phe (SEQ ID NO: 30)
Asn Cys Cys Glu Leu Cys Cys Asn Pro Ala Cys Thr
Gly Cys Tyr Asp Phe (SEQ ID NO: 31)
Asn Cys Cys Glu Leu Cys Cys Asn Pro Ala Cys Trp
Gly Cys Tyr Asp Phe (SEQ ID NO: 32)
Asn Cys Cys Glu Phe Cys Cys Asn Pro Ala Cys Thr
Gly Cys Tyr Asp Phe (SEQ ID NO: 33)
Asn Cys Cys Glu Tyr Cys Cys Asn Pro Ala Cys Thr
Gly Cys Tyr Asp Phe (SEQ ID NO: 34)
Asn Cys Cys Glu Trp Cys Cys Asn Pro Ala Cys Thr
Gly Cys Tyr Asp Phe (SEQ ID NO: 35)
Asn Cys Cys Glu Arg Cys Cys Asn Pro Ala Cys Thr
Gly Cys Tyr Asp Phe (SEQ ID NO: 36)
Asn Cys Cys Glu Lys Cys Cys Asn Pro Ala Cys Thr
Gly Cys Tyr Asp Phe In some cases, the peptides of the invention are produced as a prepro protein that includes the amino terminal leader sequence: mkksilfiflsvlsfspfaqdakpvesskekitleskkcniakksnk sgpesmn. Where the peptide is produced by a bacterial cell, e.g., *E. coli*, the forgoing leader sequence will be cleaved and the mature peptide will be efficiently secreted from the bacterial cell. U.S. Pat. No. 5,395,490 describes vectors, expression systems and methods for the efficient production of ST peptides in bacterial cells and methods for achieving efficient secretion of mature ST peptides. The vectors, expression systems and methods described in U.S. Pat. No. 5,395,490 can be used to produce the ST peptides and variant ST peptides of the present invention Variant Peptides The invention includes variant peptides which can include one, two, three, four, five, six, seven, eight, nine, or ten (in some embodiments fewer than 5 or fewer than 3 or 2 or fewer) amino acid substitutions and/or deletions compared to SEQ ID NOs: 6 to 99 and 1669-2080. The substitution(s) can be conservative or non-conservative. The naturally-occurring amino acids can be substituted by D-isomers of any amino acid, non-natural amino acids; natural and natural amino acid analogs and other groups. A conservative amino acid substitution results in the alteration of an amino acid for a similar acting amino acid, or amino acid of like charge, polarity, or hydrophobicity. At some positions, even conservative amino acid substitutions can alter the activity of the peptide. A conservative substitution can substitute a naturally-occurring amino acid for a non-naturally-occurring amino acid. The amino acid substitutions among naturally-occurring amino acids are listed in Table II.

TABLE II

| For Amino Acid | Code | Replace with any of |
| --- | --- | --- |
| Alanine | Ala | Gly, Cys, Ser |
| Arginine | Arg | Lys, His |
| Asparagine | Asn | Asp, Glu, Gln, |
| Aspartic Acid | Asp | Asn, Glu, Gln |
| Cysteine | Cys | Met, Thr, Ser |
| Glutamine | Gln | Asn, Glu, Asp |
| Glutamic Acid | Glu | Asp, Asn, Gln |
| Glycine | Gly | Ala |
| Histidine | His | Lys, Arg |
| Isoleucine | Ile | Val, Leu, Met |
| Leucine | Leu | Vai, Ile, Met |
| Lysine | Lys | Arg, His |
| Methionine | Met | Ile, Leu, Val |
| Phenylalanine | Phe | Tyr, His, Trp |
| Proline | Pro |  |
| Serine | Ser | Thr, Cys, Ala |
| Threonine | Thr | Ser, Met, Val |
| Tryptophan | Trp | Phe, Tyr |
| Tyrosine | Tyr | Phe, His |
| Valine | Val | Leu, Ile, Met |

In some circumstances it can be desirable to treat patients with a variant peptide that binds to and activates intestinal GC-C receptor, but is less active than the non-variant form the peptide. This reduced activity can arise from reduced affinity for the receptor or a reduced ability to activate the receptor once bound or reduced stability of the peptide.

Production of Peptides

Useful peptides can be produced either in bacteria including, without limitation, *E. coli*, or in other existing systems for peptide or protein production (e.g., *Bacillus subtilis*, baculovirus expression systems using *Drosophila* Sf9 cells, yeast or filamentous fungal expression systems, mammalian cell expression systems), or they can be chemically synthesized.

If the peptide or variant peptide is to be produced in bacteria, e.g., *E. coli*, the nucleic acid molecule encoding the peptide will preferably also encode a leader sequence that permits the secretion of the mature peptide from the cell. Thus, the sequence encoding the peptide can include the pre sequence and the pro sequence of, for example, a naturally-occurring bacterial ST peptide. The secreted, mature peptide can be purified from the culture medium.

The sequence encoding a peptide of the invention is preferably inserted into a vector capable of delivering and maintaining the nucleic acid molecule in a bacterial cell. The DNA molecule may be inserted into an autonomously replicating vector (suitable vectors include, for example, pGEM3Z and pcDNA3, and derivatives thereof). The vector nucleic acid may be a bacterial or bacteriophage DNA such as bacteriophage lambda or M13 and derivatives thereof. Construction of a vector containing a nucleic acid described herein can be followed by transformation of a host cell such as a bacterium. Suitable bacterial hosts include but are not limited to, *E. coli, B. subtilis, Pseudomonas, Salmonella*. The genetic construct also includes, in addition to the encoding nucleic acid molecule, elements that allow expression, such as a promoter and regulatory sequences. The expression vectors may contain transcriptional control sequences that control transcriptional initiation, such as promoter, enhancer, operator, and repressor sequences. A variety of transcriptional control sequences are well known to those in the art. The expression vector can also include a translation regulatory sequence (e.g., an untranslated 5' sequence, an untranslated 3' sequence, or an internal ribosome entry site). The vector can be capable of autonomous replication or it can integrate into host DNA to ensure stability during peptide production.

The protein coding sequence that includes a peptide of the invention can also be fused to a nucleic acid encoding a polypeptide affinity tag, e.g., glutathione S-transferase (GST), maltose E binding protein, protein A, FLAG tag, hexa-histidine, myc tag or the influenza HA tag, in order to facilitate purification. The affinity tag or reporter fusion joins the reading frame of the peptide of interest to the reading frame of the gene encoding the affinity tag such that a translational fusion is generated. Expression of the fusion gene results in translation of a single polypeptide that includes both the peptide of interest and the affinity tag. In some instances where affinity tags are utilized, DNA sequence encoding a protease recognition site will be fused between the reading frames for the affinity tag and the peptide of interest.

Genetic constructs and methods suitable for production of immature and mature forms of the peptides and variants of the invention in protein expression systems other than bacteria, and well known to those skilled in the art, can also be used to produce peptides in a biological system.

Mature peptides and variants thereof can be synthesized by the solid-phase chemical synthesis. For example, the peptide can be synthesized on Cyc(4-$CH_2$ Bxl)-$OCH_2$-4-(oxymethyl)-phenylacetamidomethyl resin using a double coupling program. Protecting groups must be used appropriately to create the correct disulfide bond pattern. For example, the following protecting groups can be used: t-butyloxycarbonyl (alpha-amino groups); acetamidomethyl (thiol groups of Cys residues B and E); 4-methylbenzyl (thiol groups of Cys residues C and F); benzyl (y-carboxyl of glutamic acid and the hydroxyl group of threonine, if present); and bromobenzyl (phenolic group of tyrosine, if present). Coupling is effected with symmetrical anhydride of t-butoxylcarbonylamino acids or hydroxybenzotriazole ester (for asparagine or glutamine residues), and the peptide is deprotected and cleaved from the solid support in hydrogen fluoride, dimethyl sulfide, anisole, and p-thiocresol using 8/1/1/0.5 ratio (v/v/v/w) at 0° C. for 60 min. After removal of hydrogen fluoride and dimethyl sulfide by reduced pressure and anisole and p-thiocresol by extraction with ethyl ether and ethyl acetate sequentially, crude peptides are extracted with a mixture of 0.5M sodium phosphate buffer, pH 8.0 and N,N-dimethylformamide using 1/1 ratio, v/v. The disulfide bond for Cys residues B and E is the formed using dimethyl sulfoxide (Tam et al. (1991) *J. Am. Chem. Soc.* 113:6657-62). The resulting peptide is the purified by reverse-phase chromatography. The disulfide bond between Cys residues C and F is formed by first dissolving the peptide in 50% acetic acid in water. Saturated iodine solution in glacial acetic acid is added (1 ml iodine solution per 100 ml solution). After incubation at room temperature for 2 days in an enclosed glass container, the solution is diluted five-fold with deionized water and extracted with ethyl ether four times for removal of unreacted iodine. After removal of the residual amount of ethyl ether by rotary evaporation the solution of crude product is lyophilized and purified by successive reverse-phase chromatography.

Peptides can also be synthesized by many other methods including solid phase synthesis using traditional FMOC protection (i.e., coupling with DCC-HOBt and deprotection with piperidine in DMF). Cys thiol groups can be trityl protected. Treatment with TFA can be used for final deprotection of the peptide and release of the peptide from the solid-state resin. In many cases air oxidation is sufficient to achieve proper disulfide bond formation.

Intestinal GC-C Receptor Binding Assay

The ability of peptides and other agents to bind to the intestinal GC-C receptor can be tested as follows. Cells of the T84 human colon carcinoma cell line (American Type Culture Collection (Bethesda, Md.)) are grown to confluence in 24-well culture plates with a 1:1 mixture of Ham's F12 medium and Dulbecco's modified Eagle's medium (DMEM), supplemented with 5% fetal calf serum. Cells used in the assay are typically between passages 54-60. Briefly, T84 cell monolayers in 24-well plates are washed twice with 1 ml of binding buffer (DMEM containing 0.05% bovine serum albumin and 25 mM HEPES, pH 7.2), then incubated for 30 min at 37° C. in the presence of mature radioactively labeled E. coli ST peptide and the test material at various concentrations. The cells are then washed four times with 1 ml of DMEM and solubilized with 0.5 ml/well 1N NaOH. The level of radioactivity in the solubilized material is then determined using standard methods.

Example 1

Preparation of Variant ST Peptides and Wild-Type ST Peptide

1a: Preparation of Recombinant Variant ST Peptides and Wild-Type ST Peptide

A variant ST peptide having the sequence Asn Ser Ser Asn Tyr Cys Cys Glu Tyr Cys Cys Asn Pro Ala Cys Thr Gly Cys Tyr (SEQ ID NO:5) was produced recombinantly and tested in an animal model. A peptide having the sequence of the wild-type ST peptide was also created (SEQ ID NO:4).

SEQ ID NO:5 and SEQ ID NO:4 peptides were produced as preproproteins using vectors produced as follows. A sequence encoding a heat-stable enterotoxin pre-pro sequence was amplified from pGK51/pGSK51 (ATCC 67728) using oligonucleotide MO3514 (5' CACACCATAT-GAAGAAATCAATATTATTTATTTTTCTTTCTG 3' (SEQ ID NO:1655)) and oligonucleotide MO3515 (5' CACAC-CTCGAGTTAGGTCTCCATGCTTTCAGGACCACTTTT-ATTAC 3' (SEQ ID NO: 1656)). The amplification product fragment was digested with NdeI/XhoI and ligated to the T7 expression vector, pET26b(+) (Novagen) digested with NdeI/XhoI thereby creating plasmid MB3976. The region encoding the pre-pro protein was sequenced and found to encode the amino acid sequence: mkksilfiflsvlsfspfaqdakpagssk-ekitleskkcnivkksnksgpesm (SEQ ID NO:124) which differs from the amino acid sequence of heat-stable enterotoxin a2 precursor (sta2; mkksilfiflsvlsfspfaqdakpagsskekitleskk-cnivkknnesspesm (SEQ ID NO:125); GenBank® Accession No. Q47185, GI: 3913876) at three positions (indicated by underlining and bold text) near the C-terminus. To create expression vectors with the pre-pro sequence, complementary oligos encoding each ST peptide variant or wild-type ST peptide were annealed and cloned into the MB3976 expression vector. To create MB3984 (encoding SEQ ID NO:4 peptide (wild-type ST peptide) as a prepro protein), containing the amino acid sequence, NSSNYCCELCCNPACTGCY (SEQ ID NO:4) fused downstream of the pre-pro sequence, MB 3976 was digested with BsaI/XhoI and ligated to annealed oligos MO3621 (5' GCATGAATAGTAGCAATTACTGCTGTGAATTGTGTTGTAA- TCCTGCTTGTACCGGGTGCTATTAATAAC 3' (SEQ ID NO:1657)) and MO3622 (5' TCGAGTTATTAATAGCACCCGGTACAAGCAGGATTACAACACAATTCACAGCAGTAATTGCTACTATTC 3'(SEQ ID NO:1658)). To create MB3985 (encoding SEQ ID NO:5 as a prepro protein) containing the following amino acid sequence, NSSNYCCEYCCNPACTGCY fused downstream of the pre-pro sequence, MB 3976 was digested with BsaI/XhoI and ligated to annealed oligos MO3529 (5' GCATGAATAGTAGCAATTACTGCTGTGAATATTGTTGTAATCCTGCTTGTACCGGGTGCTATTAATAAC 3' (SEQ ID NO:1659)) and MO3530 (5' TCGAGTTATTAATAGCACCCGGTACAAGCAGGATTACAACAATATTCACAGCAGTAATTGCTACTATTC 3'(SEQ ID NO: 1660)).

The SEQ ID NO:5 peptide and the SEQ ID NO:4 peptide were produced as follows. The expression vectors were transformed into *E. coli* bacterial host BL21 λ DE3 (Invitrogen). A single colony was innoculated and grown shaking overnight at 30° C. in L broth+25 mg/l kanamycin. The overnight culture was added to 3.2 L of batch medium (Glucose 25 g/l, Caseamino Acids 5 g/l, Yeast Extract 5 g/l, $KH_2PO_4$ 13.3 g/l, $(NH_4)_2HPO_4$ 4 g/l, $MgSO_4$-$7H_2O$ 1.2 g/l, Citric Acid 1.7 g/l, EDTA 8.4 mg/l, $CoCl_2$-$6H_2O$ 2.5 mg/l, $MnCl_2$-$4H_2O$ 15 mg/l, $CuCl_2$-$4H_2O$ 1.5 mg/l, $H_3BO_3$ 3 mg/l, $Na_2MoO_4$-$2H_2O$ 2.5 mg/l, Zn Acetate-$2H_2O$ 13 mg/l, Ferric Citrate 100 mg/l, Kanamycin 25 mg/l, Antifoam $DF_2O_4$ 1 ml/l) and fermented using the following process parameters: pH 6.7—control with base only (28% $NH_4OH$), 30° C., aeration: 5 liters per minute. After the initial consumption of batch glucose (based on monitoring dissolved oxygen (DO) levels), 1.5 L of feed medium (Glucose 700 g/l, Caseamino Acids 10 g/l, Yeast Extract 10 g/l, $MgSO_4$-$7H_2O$ 4 g/l, EDTA 13 mg/l, $CoCl_2$-$6H_2O$ 4 mg/l, $MnCl_2$-$4H_2O$ 23.5 mg/l, $CuCl_2$-$4H_2O$ 2.5 mg/l, $H_3BO_3$ 5 mg/l, $Na_2MoO_4$-$2H_2O$ 4 mg/l, Zn Acetate-$2H_2O$ 16 mg/l, Ferric Citrate 40 mg/l, Antifoam $DF_2O_4$ 1 ml/l) was added at a feed rate controlled to maintain 20% DO. IPTG was added to 0.2 mM 2 hours post feed start. The total run time was approximately 40-45 hours (until feed exhaustion).

Cells were collected by centrifugation at 5,000 g for 10 minutes. The cell pellet was discarded and the supernatant was passed through a 50 Kd ultrafiltration unit. The 50 Kd filtrate (0.6 liters) was loaded onto a 110 ml Q-Sepharose fast Flow column (Amersham Pharmacia, equilibrated with 20 mM Tris-HCl pH 7.5) at a flow rate of 400 ml/hour. The column was washed with six volumes of 20 mM Tris-HCl pH 7.5 and proteins were eluted with 50 mM acetic acid collecting 50 ml fractions. Fractions containing ST peptide variant or wild-type ST peptide were pooled and the solvent was removed by rotary evaporation. The dried proteins were resuspended in 10 ml of 8% acetic acid, 0.1% trifluoroacetic acid (TFA) and loaded onto a Varian Polaris C18-A column (250×21.2 mm 10 μm, equilibrated in the same buffer) at a flow rate of 20 ml/min. The column was washed with 100 ml of 8% methanol, 0.1% TFA and developed with a gradient (300 ml) of 24 to 48% methanol, 0.1% TFA, collecting 5-ml fractions. Fractions containing peptide were pooled and the solvent was removed by rotary evaporation. The peptides were dissolved in 0.1% TFA and lyophilized.

The SEQ ID NO:5 peptide and SEQ ID NO:4 peptide fractions were analyzed by standard LCMS and HPLC. LCMS analysis revealed that SEQ ID NO:5 peptide is more homogeneous than SEQ ID NO: 4 peptide (see FIG. 1a; note that SEQ ID NO:5 peptide exhibits fewer peaks (Panel B) than SEQ ID NO:4 peptide (Panel A)).

1b: Preparation of Synthetic Variant ST Peptides and Wild-Type ST Peptide

Peptides were chemically synthesized by a commercial peptide synthesis company. Varying yields of peptides were obtained depending on the efficiency of chemical synthesis. Thus, the four peptides, in decreasing order of yield were: Cys Cys Glu Tyr Cys Cys Asn Pro Ala Cys Thr Gly Cys Tyr (SEQ ID NO:3), 10-20% yield; Cys Cys Glu Leu Cys Cys Asn Pro Ala Cys Thr Gly Cys Tyr (SEQ ID NO:6); Asn Ser Ser Asn Tyr Cys Cys Glu Tyr Cys Cys Asn Pro Ala Cys Thr Gly Cys Tyr (SEQ ID NO:5); Asn Ser Ser Asn Tyr Cys Cys Glu Leu Cys Cys Asn Pro Ala Cys Thr Gly Cys Tyr (SEQ ID NO:SEQ ID NO:4), <5% yield. Thus the specific amino acid changes introduced into the peptides can create improved manufacturing properties.

Figure 1B:
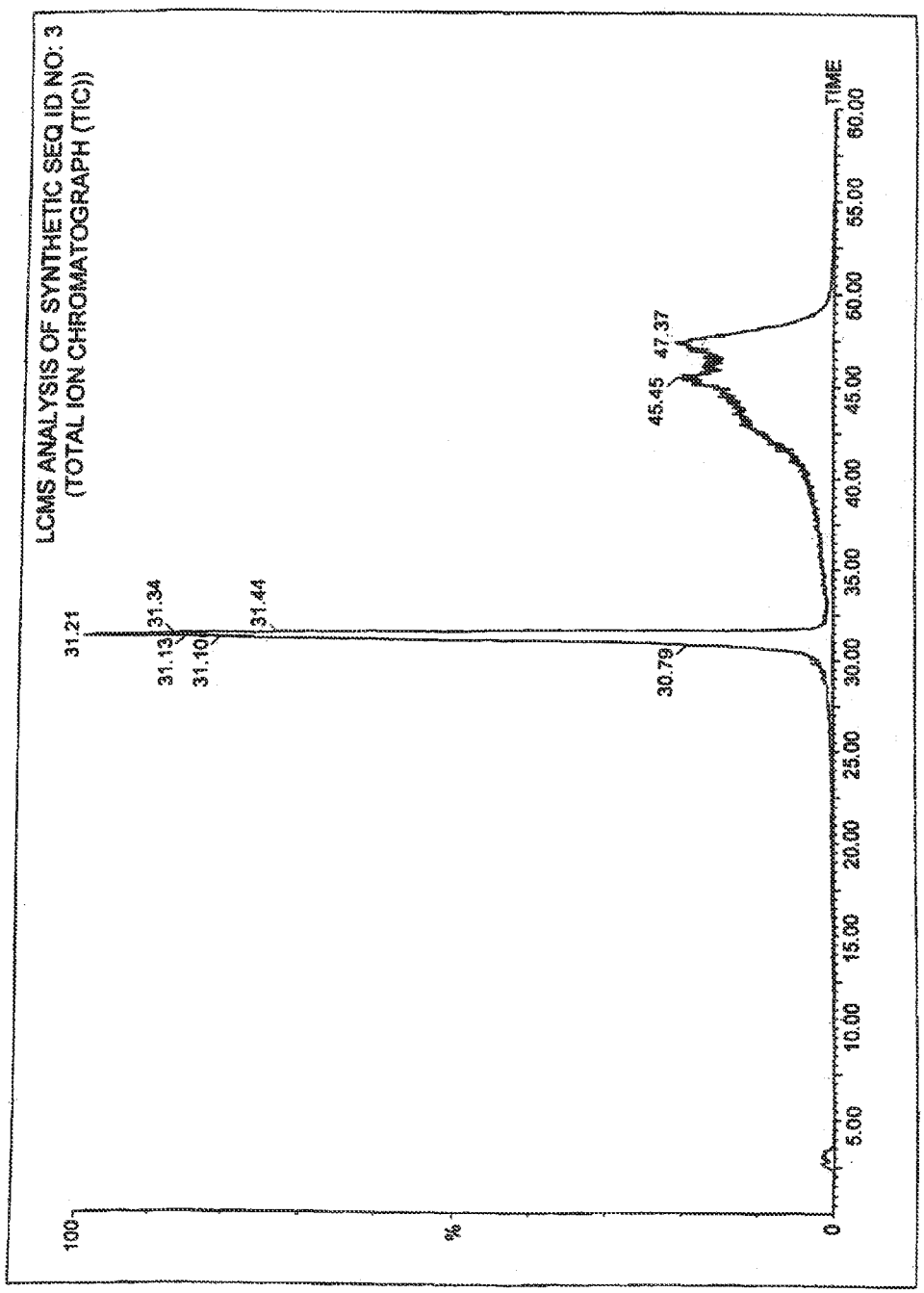
FIGS. 1B and 1C depict the results of LCMS analysis of synthetic SEQ ID NO:3 peptide and the blank.
Figure 1C:
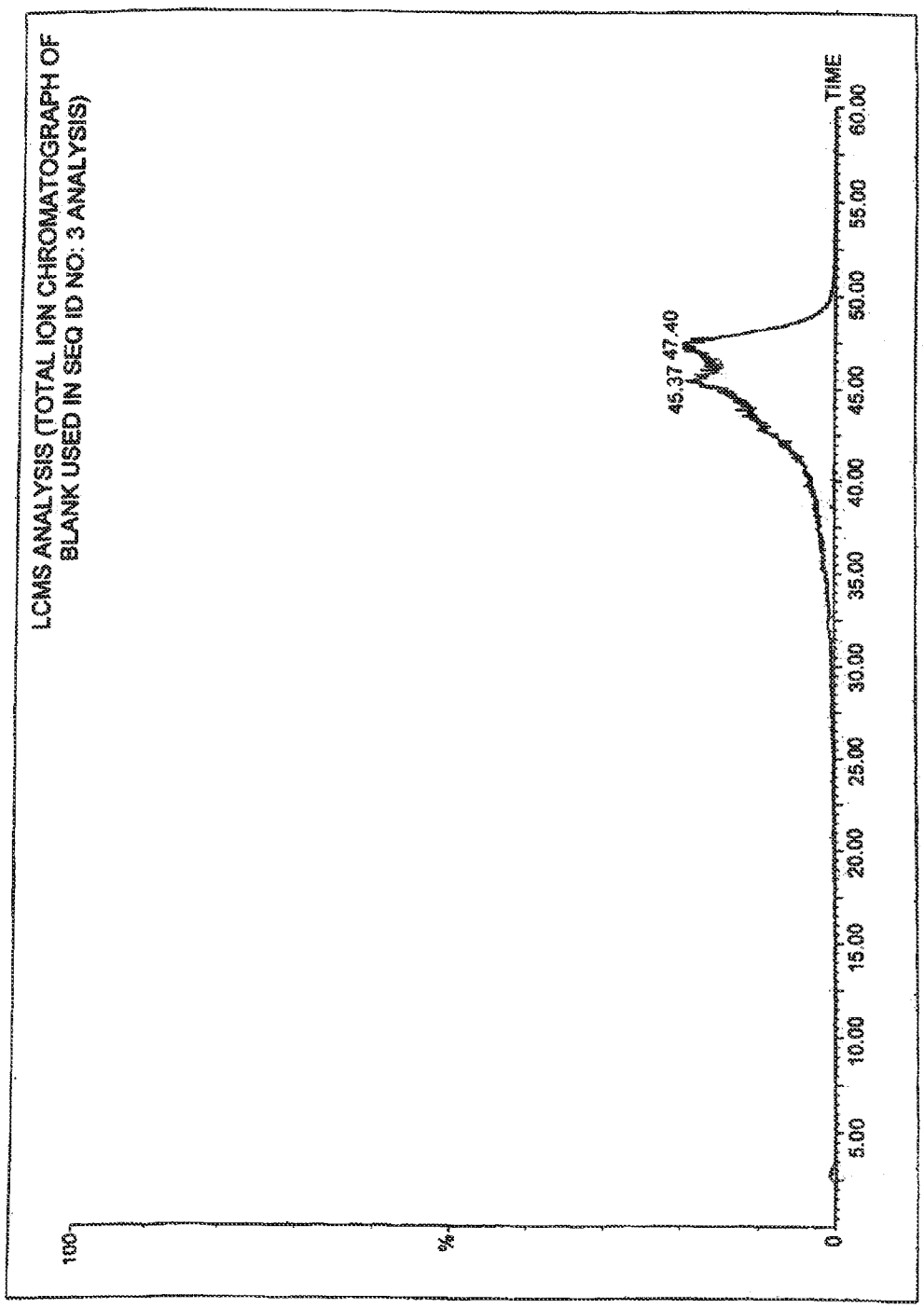

FIG. 1b shows the total ion chromatograph profile of synthetically manufactured SEQ ID NO:3 peptide. FIG. 1c shows the total ion chromatograph profile of the control blank sample. There is one major peak present in the SEQ ID NO:3 peptide sample that is not also present in the control sample. Quantitative analysis suggests the SEQ ID NO:3 peptide is >98% pure.

Example 2

Activation of the Intestinal GC-C Receptor by a Variant ST Peptide and ST Peptide The ability of SEQ ID NO:5, SEQ ID NO:4, and SEQ ID NO:3 to activate the intestinal GC-C receptor was assessed in an assay employing the T84 human colon carcinoma cell line (American Type Culture Collection (Bethesda, Md.)). For the assays cells were grown to confluency in 24-well culture plates with a 1:1 mixture of Ham's F12 medium and Dulbecco's modified Eagle's medium (DMEM), supplemented with 5% fetal calf serum and were used at between passages 54 and 60.

Briefly, monolayers of T84 cells in 24-well plates were washed twice with 1 ml/well DMEM, then incubated at 37° C. for 10 min with 0.45 ml DMEM containing 1 mM isobutyl-methylxanthine (IBMX), a cyclic nucleotide phosphodiesterase inhibitor. Test peptides (50 µl) were then added and incubated for 30 minutes at 37° C. The media was aspirated and the reaction was then terminated by the addition of ice cold 0.5 ml of 0.1N HCl. The samples were held on ice for 20 minutes and then evaporated to dryness using a heat gun or vacuum centrifugation. The dried samples were resuspended in 0.5 ml of phosphate buffer provided in the Cayman Chemical Cyclic GMP EIA kit (Cayman Chemical, Ann Arbor, Mich.). Cyclic GMP was measured by EIA according to procedures outlined in the Cayman Chemical Cyclic GMP EIA kit.

Figure 2:
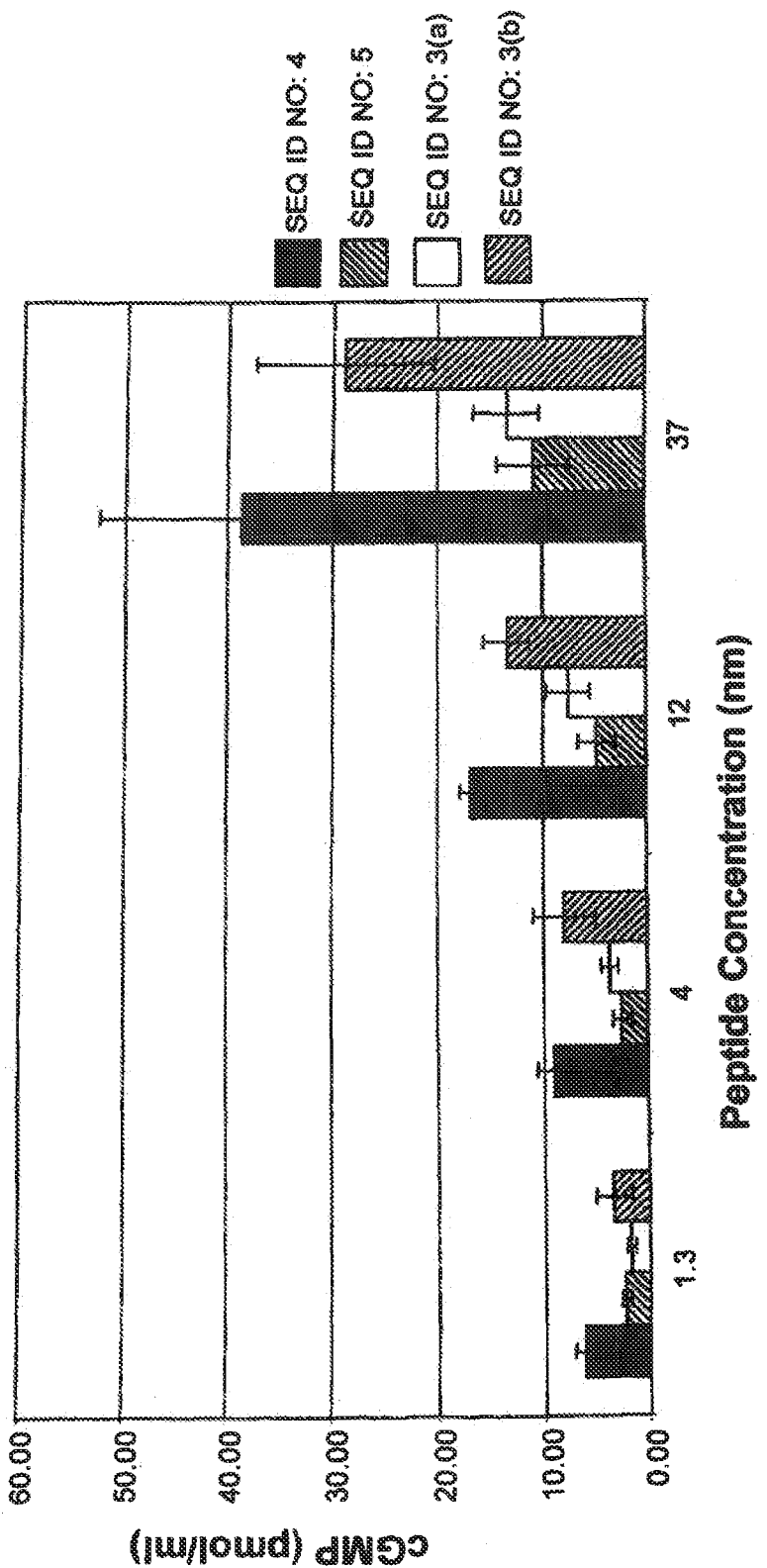
FIG. 2 depicts the results of the intestinal GC-C receptor activity assay of synthetic SEQ ID NO:4 peptide, SEQ ID NO:5 peptide and two different SEQ ID NO:3 peptides.

FIG. 2 shows the activity of chemically synthesized peptide variants in this GC-C receptor activity assay. In this assay, SEQ ID NO:4 and two different SEQ ID NO:3 peptides (SEQ ID NO:3(a) and SEQ ID NO:3(b), synthesized by two different methods) had activity comparable to SEQ ID NO:4. SEQ ID NO:5 and SEQ ID NO:4 peptide were chemically synthesized in a manner identical to that of SEQ ID NO:3(b).

Example 3

SEQ ID NO:5 and SEQ ID NO:4 Increase Intestinal Transit in Mice

In order to determine whether the peptides increase the rate of gastrointestinal transit, the peptides and controls were tested using a murine gastrointestinal transit (GIT) assay (Moon et al. *Infection and Immunity* 25:127, 1979). In this assay, charcoal, which can be readily visualized in the gastrointestinal tract is administered to mice after the administration of a test compound. The distance traveled by the charcoal is measured and expressed as a percentage of the total length of the colon.

Mice were fasted with free access to water for 12 to 16 hours before the treatment with peptide or control buffer. The peptides were orally administered at 1 µg/kg-1 mg/kg of peptide in buffer (20 mM Tris pH 7.5) 7 minutes before being given an oral dose of 5% Activated Carbon (Aldrich 242276-250G). Control mice were administered buffer only before being given a dose of Activated Carbon. After 15 minutes, the mice were sacrificed and their intestines from the stomach to the cecum were dissected. The total length of the intestine as well as the distance traveled from the stomach to the charcoal front was measured for each animal and the results are expressed as the percent of the total length of the intestine traveled by the charcoal front. All results are reported as the average of 10 mice±standard deviation. A comparison of the distance traveled by the charcoal between the mice treated with peptide versus the mice treated with vehicle alone was performed using a Student's t test and a statistically significant difference was considered for P<0.05. P-values are calculated using a two-sided T-Test assuming unequal variances.

Figure 3A:
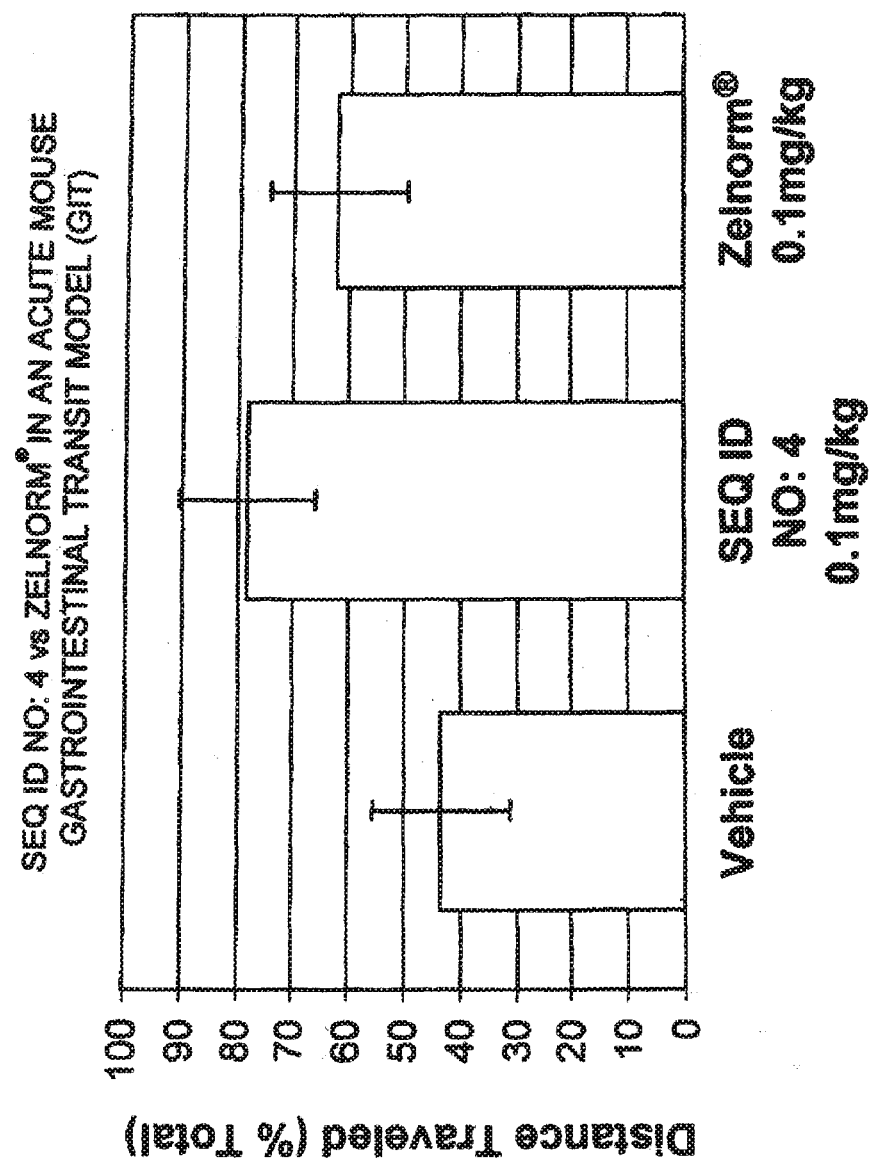
FIG. 3A depicts the effect of recombinant SEQ ID NO:4 peptide and Zelnorm® in an acute murine gastrointestinal transit model.
Figure 4A:
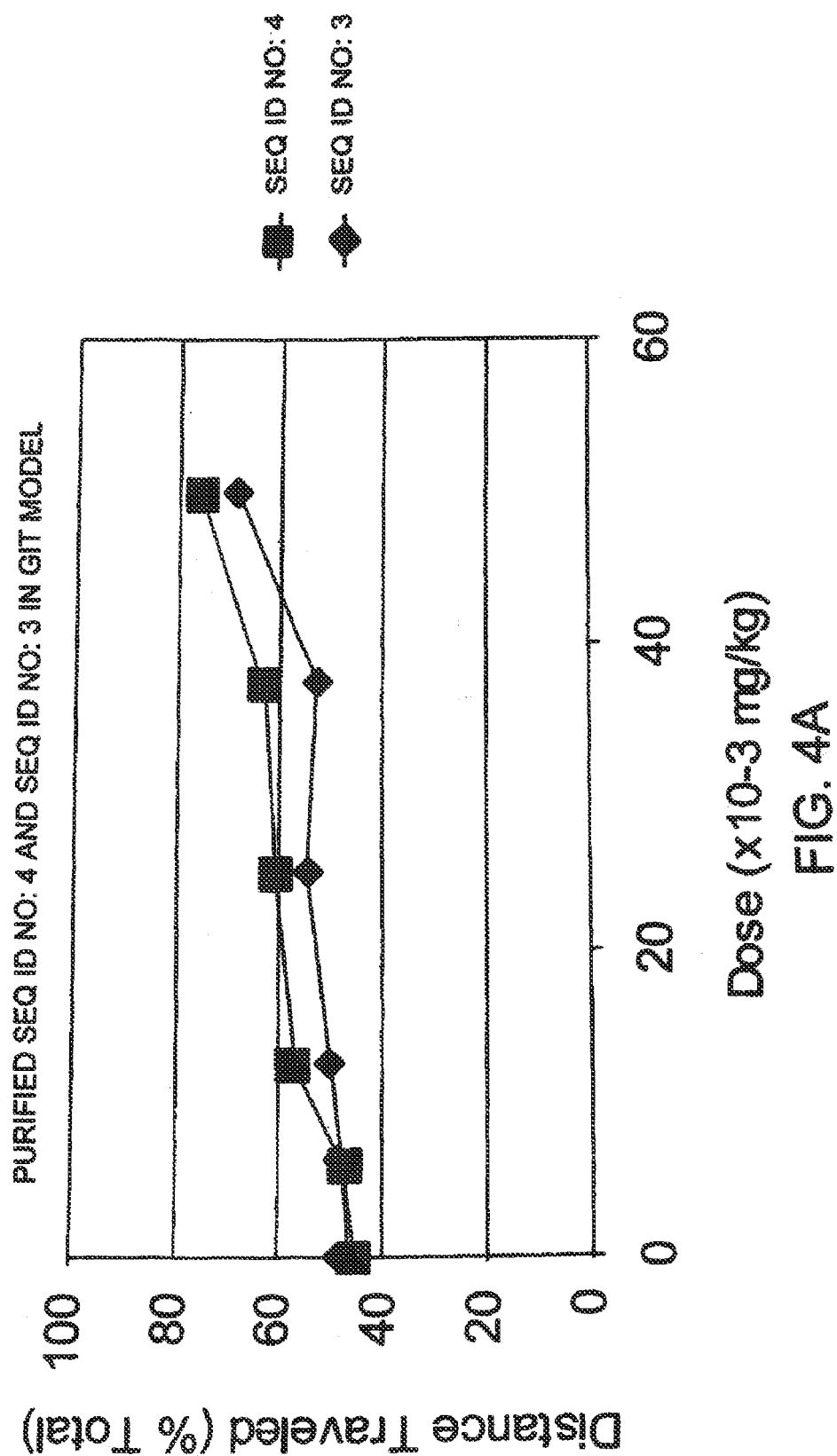
FIGS. 4A and 4B depict the effect of peptides SEQ ID NO:5, SEQ ID NO:3, and SEQ ID NO:4 in an acute murine gastrointestinal transit model.
Figure 4B:
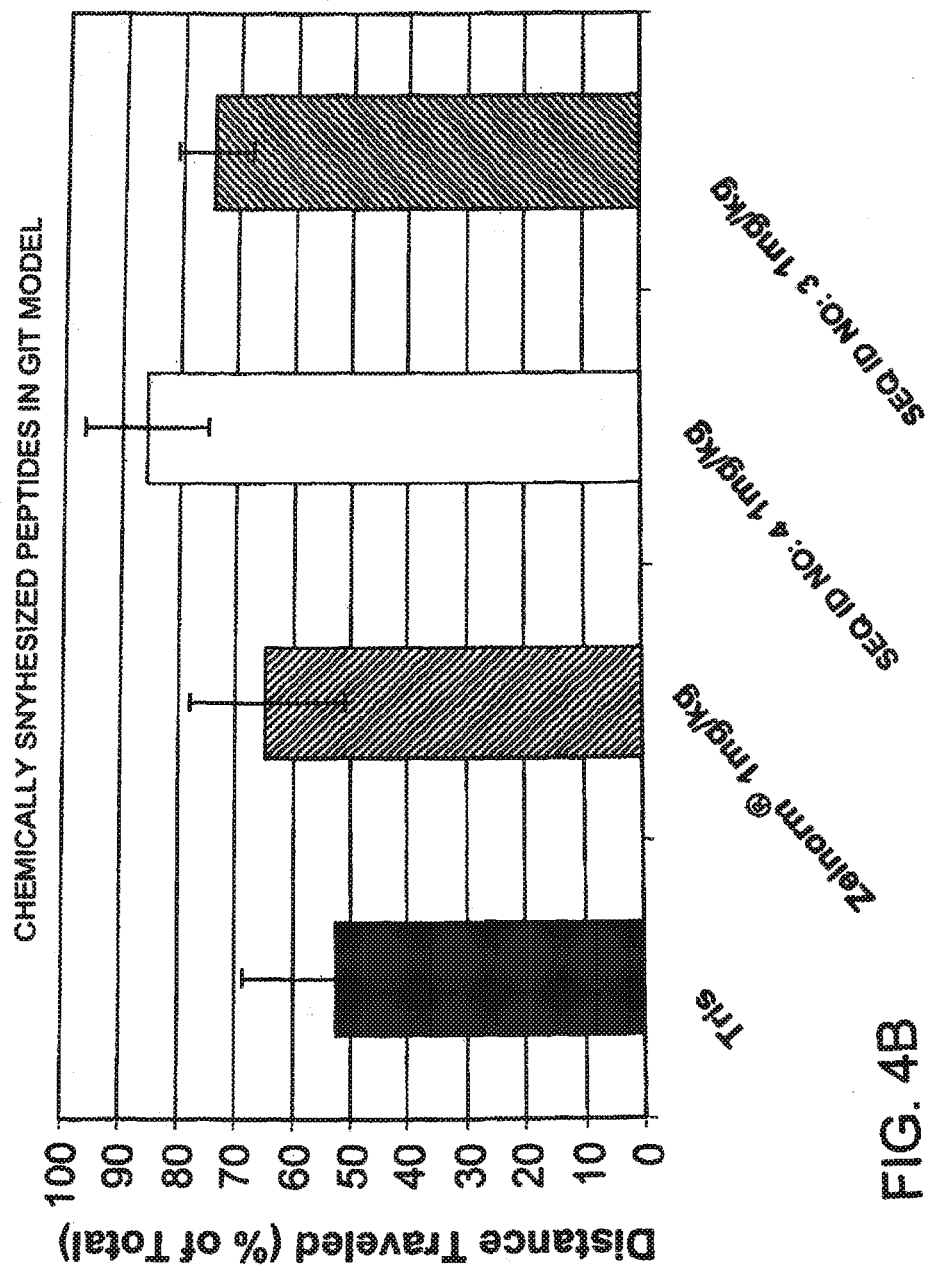

As can be seen in FIG. 3a and FIG. 3b, wild-type ST peptide (SEQ ID NO:4, (Sigma-Aldrich, St Louis, Mo.); 0.1 mg/kg), synthetically manufactured SEQ ID NO:3 and Zelnorm® (0.1 mg/kg), a drug approved for IBS that is an agonist for the serotonin receptor 5HT4, increase gastrointestinal transit rate in this model. FIG. 4a shows the result of a study demonstrating that intestinal transit rate increases with an increasing dosage of either recombinantly synthesized SEQ ID NO:4 or SEQ ID NO:5. FIG. 4b shows the results of a study demonstrating both chemically synthesized SEQ ID NO:4 or SEQ ID NO:3 peptide increase intestinal transit rates more than either Tris buffer alone or an equivalent dose of Zelnorm®.

The identical experiment was performed to determine if SEQ ID NO:3 is effective in a chronic dosing treatment regimen. Briefly, 8 week old CD1 female mice are dosed orally once a day for 5 days with either SEQ ID NO:3 (0.06 mg/kg or 0.25 mg/kg in 20 mM Tris pH 7.5) or vehicle alone (20 mM Tris pH 7.5). On the $5^{th}$ day, a GIT assay is performed identical to that above except 200 µl of a 10% charcoal solution is administered. FIG. 4c shows the results of a study demonstrating both chemically synthesized SEQ ID NO:3 or Zelnorm® are effective in a mouse gastrointestinal motility assay upon chronic dosing (daily for 5 days). The results are shown side by side with acute dosing (1 day).

Example 4

SEQ ID NO:5 Peptide and SEQ ID NO:4 Peptide Increase Intestinal Secretion in Suckling Mice (SuMi Assay)

Figure 5A:
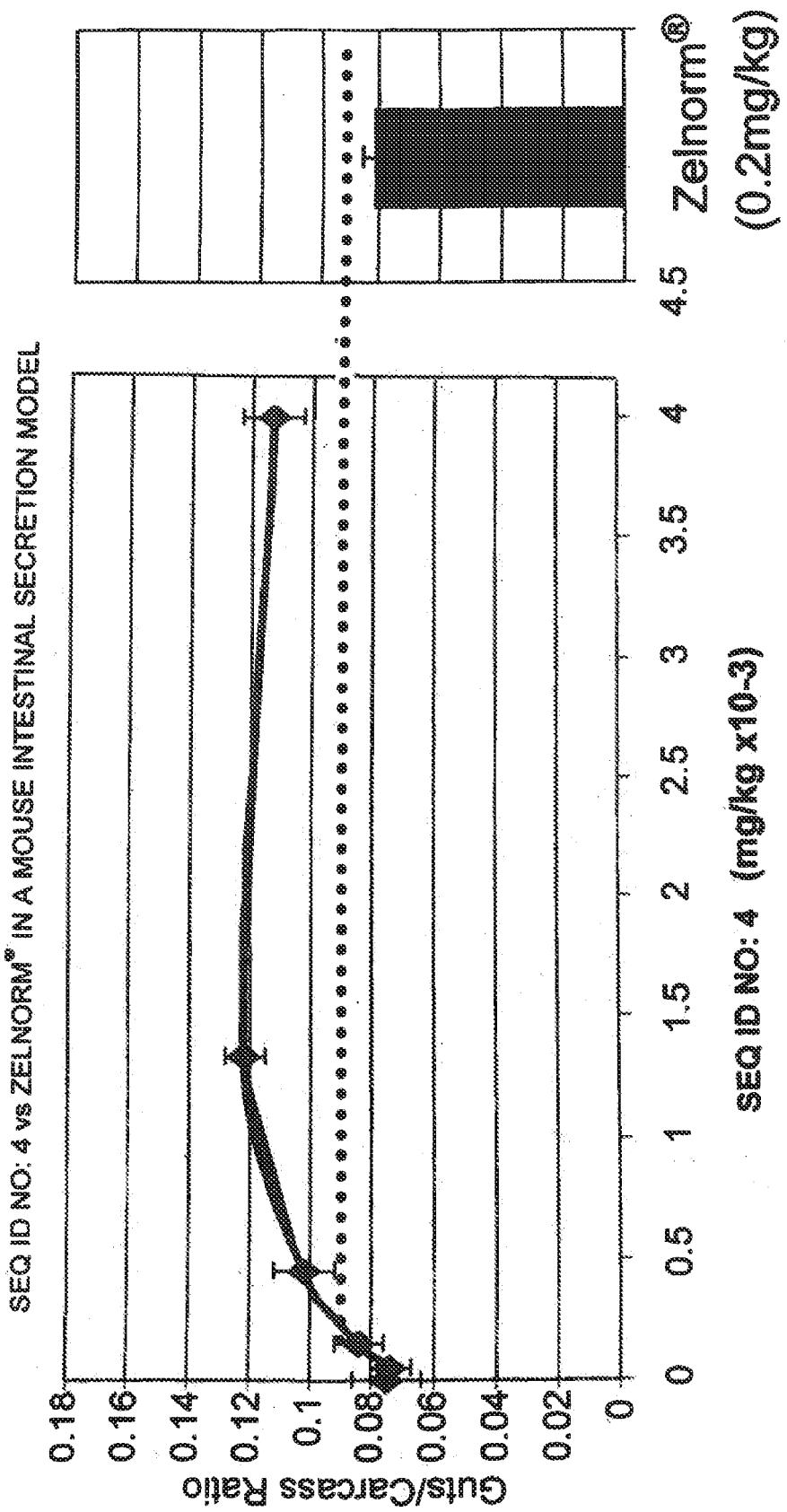
FIG. 5A depicts the effect of SEQ ID NO:4 peptide and Zelnorm® in a suckling mouse intestinal secretion model.
Figure 6B:
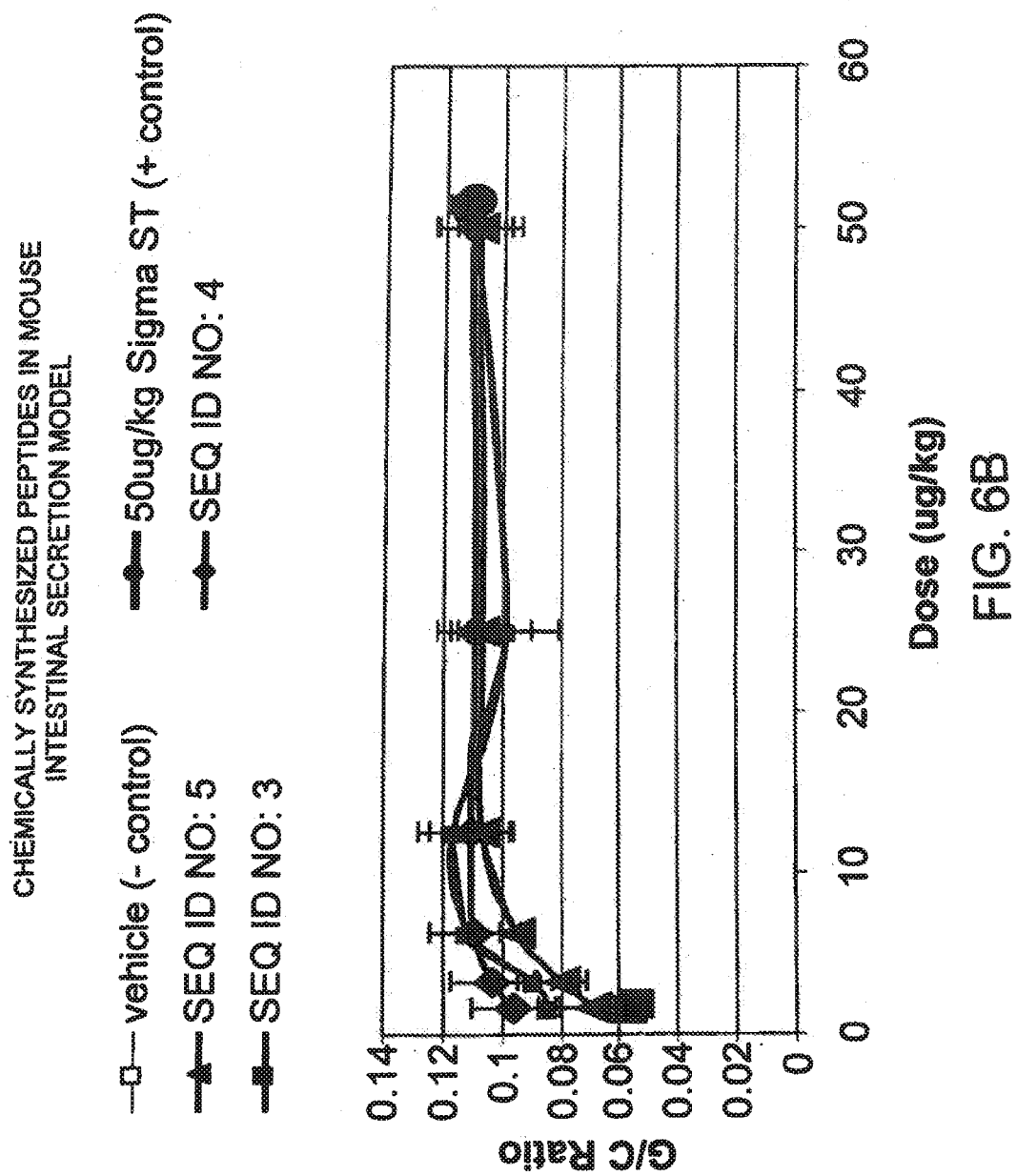

SEQ ID NO:4 peptide and SEQ ID NO:5 were tested for their ability to increase intestinal secretion using a suckling mouse model of intestinal secretion. In this model a test compound is administered to suckling mice that are between 7 and 9 days old. After the mice are sacrificed, the gastrointestinal tract from the stomach to the cecum is dissected ("guts"). The remains ("carcass") as well as the guts are weighed and the ratio of guts to carcass weight is calculated. If the ratio is above 0.09, one can conclude that the test compound increases intestinal secretion. FIG. 5a shows a dose response curve for wild-type ST peptide (SEQ ID NO:4) in this model. FIG. 5b shows dose response curve for the SEQ ID NO:3 peptide in this model. These data show that wild-type ST peptide (purchased from TDT, Inc. West Chester, Pa.) and the SEQ ID NO:3 peptide increase intestinal secretion. The effect of Zelnorm® was also studied. As can be seen from FIG. 5, Zelnorm® at 0.2 mg/kg does not increase intestinal secretion in this model. FIG. 6a shows a dose response curve for the recombinant SEQ ID NO:4 peptide described above and the recombinant SEQ ID NO:5 peptide described above. As can be seen from FIG. 6a, both peptides increase intestinal secretion in this model. Similarly FIG. 6b shows a dose response curve for chemically synthesized SEQ ID NO:5, SEQ ID NO:3 and SEQ ID NO:4 as well as wild-type ST peptide (purchased from Sigma-Aldrich, St Louis, Mo.).

Colonic Hyperalgesia Animal Models

Hypersensitivity to colorectal distension is common in patients with IBS and may be responsible for the major symptom of pain. Both inflammatory and non-inflammatory animal models of visceral hyperalgesia to distension have been developed to investigate the effect of compounds on visceral pain in IBS.

I. Trinitrobenzenesulphonic Acid (TNBS)-Induced Rectal Allodynia Model

Male Wistar rats (220-250 g) were premedicated with 0.5 mg/kg of acepromazine injected intraperitoneally (IP) and anesthetized by intramuscular administration of 100 mg/kg of ketamine. Pairs of nichrome wire electrodes (60 cm in length and 80 µm in diameter) were implanted in the striated muscle of the abdomen, 2 cm laterally from the white line. The free ends of electrodes were exteriorized on the back of the neck and protected by a plastic tube attached to the skin. Electromyographic (EMG) recordings were started 5 days after surgery. Electrical activity of abdominal striated muscle was recorded with an electroencephalograph machine (Mini VIII, Alvar, Paris, France) using a short time constant (0.03 sec.) to remove low-frequency signals (<3 Hz).

Ten days post surgical implantation, trinitrobenzenesulphonic acid (TNBS) was administered to induce rectal inflammation. TNBS (80 mg kg$^{-1}$ in 0.3 ml 50% ethanol) was administered intrarectally through a silicone rubber catheter introduced at 3 cm from the anus under light diethyl-ether anesthesia, as described (Morteau et al. 1994 Dig Dis Sci 39:1239). Following TNBS administration, rats were placed in plastic tunnels where they were severely limited in mobility for several days before colorectal distension (CRD). Experimental compound was administered one hour before CRD which was performed by insertion into the rectum, at 1 cm of the anus, a 4 cm long balloon made from a latex condom (Gue et al, 1997 Neurogastroenterol. Motil. 9:271). The balloon was fixed on a rigid catheter taken from an embolectomy probe (Fogarty). The catheter attached balloon was fixed at the base of the tail. The balloon, connected to a barostat, was inflated progressively by step of 15 mmHg, from 0 to 60 mmHg, each step of inflation lasting 5 min. Evaluation of rectal sensitivity, as measured by EMG, was performed before (1-2 days) and 3 days following rectal instillation of TNBS.

The number of spike bursts that corresponds to abdominal contractions was determined per 5 min periods. Statistical analysis of the number of abdominal contractions and evaluation of the dose-effects relationships was performed by a one way analysis of variance (ANOVA) followed by a post-hoc (Student or Dunnett tests) and regression analysis for ED50 if appropriate.

Figure 7:
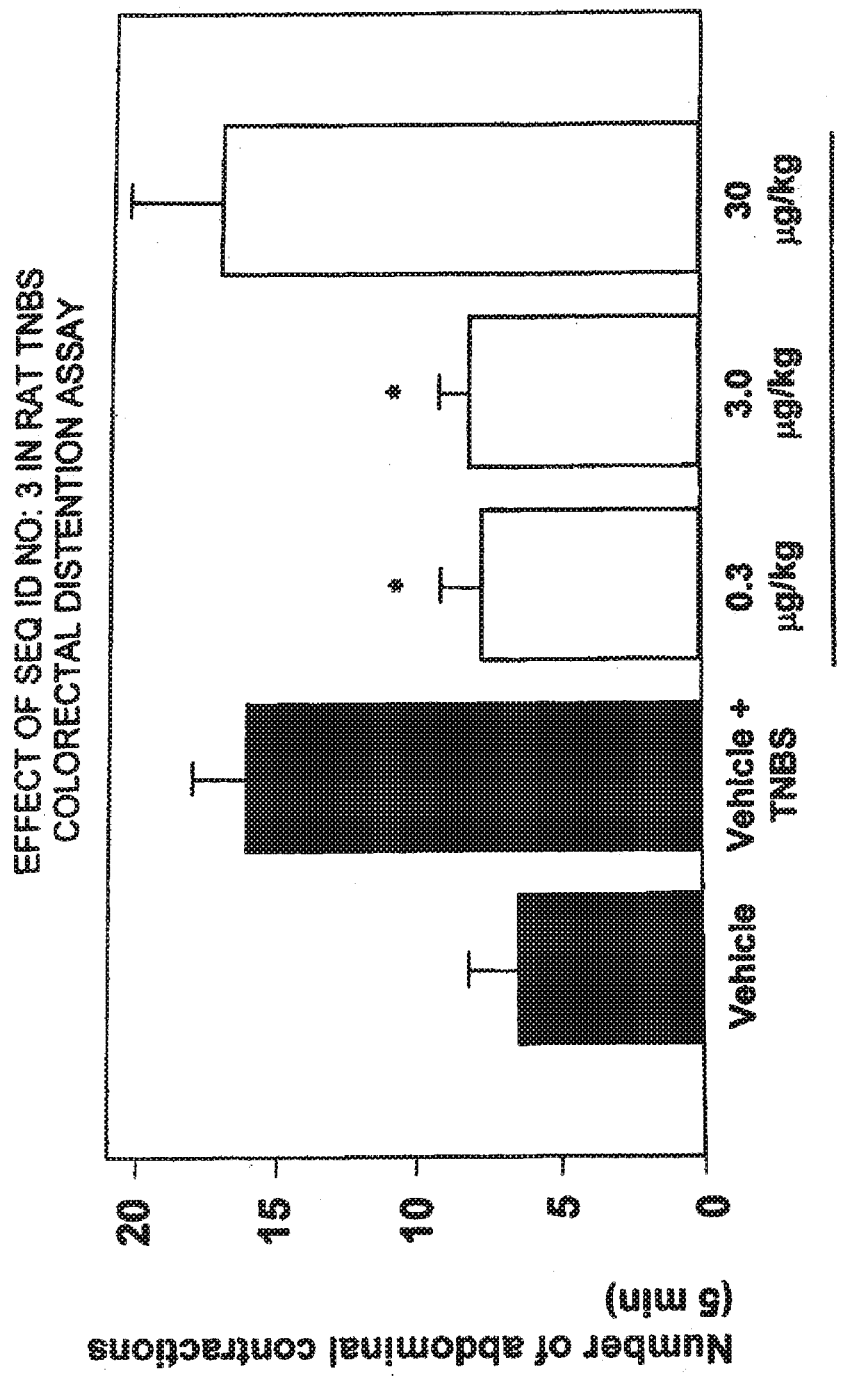
FIG. 7 shows the results of experiment in which SEQ ID NO:3 activity was analyzed in the TNBS colonic distention model.

FIG. 7 shows the results of experiment in which SEQ ID NO:3 activity was analyzed in the TNBS colorectal model. Significant decreases in abdominal response are observed at 0.3 µg/kg and 3 µg/kg SEQ ID NO:3. These results demonstrate that SEQ ID NO:3 reduces pain associated with colorectal distension in this animal model.

II. Stress-Induced Hyperalgesia Model

Male Wistar Rats (200-250 g) are surgically implanted with nichrome wire electrodes as in the TNBS model. Ten days post surgical implantation, partial restraint stress (PRS), is performed as described by Williams et al. for two hours (Williams et al. 1988 Gastroenterology 64:611). Briefly, under light anesthesia with ethyl-ether, the foreshoulders, upper forelimbs and thoracic trunk are wrapped in a confining harness of paper tape to restrict, but not prevent body movements. Control sham-stress animals are anaesthetized but not wrapped. Thirty minutes before the end of the PRS session, the animals are administered test-compound or vehicle. Thirty minutes to one hour after PRS completion, the CRD distension procedure is performed as described above for the TNBS model with barostat at pressures of 15, 30, 45 and 60 mm Hg. Statistical analysis on the number of bursts is determined and analyzed as in the TNBS model above.

Phenylbenzoquinone-Induced Writhing Model

The PBQ-induced writhing model can be used to assess pain control activity of the peptides and GC-C receptor agonists of the invention. This model is described by Siegmund et al. (1957 Proc. Soc. Exp. Bio. Med. 95:729-731). Briefly, one hour after oral dosing with a test compound, e.g., a peptide, morphine or vehicle, 0.02% phenylbenzoquinone (PBQ) solution (12.5 mL/kg) is injected by intraperitoneal route into the mouse. The number of stretches and writhings are recorded from the 5$^{th}$ to the 10$^{th}$ minute after PBQ injection, and can also be counted between the 35$^{th}$ and 40$^{th}$ minute and between the 60$^{th}$ and 65$^{th}$ minute to provide a kinetic assessment. The results are expressed as the number of stretches and writhings (mean±SEM) and the percentage of variation of the nociceptive threshold calculated from the mean value of the vehicle-treated group. The statistical significance of any differences between the treated groups and the control group is determined by a Dunnett's test using the residual variance after a one-way analysis of variance (P<0.05) using SigmaStat Software.

Figure 8A:
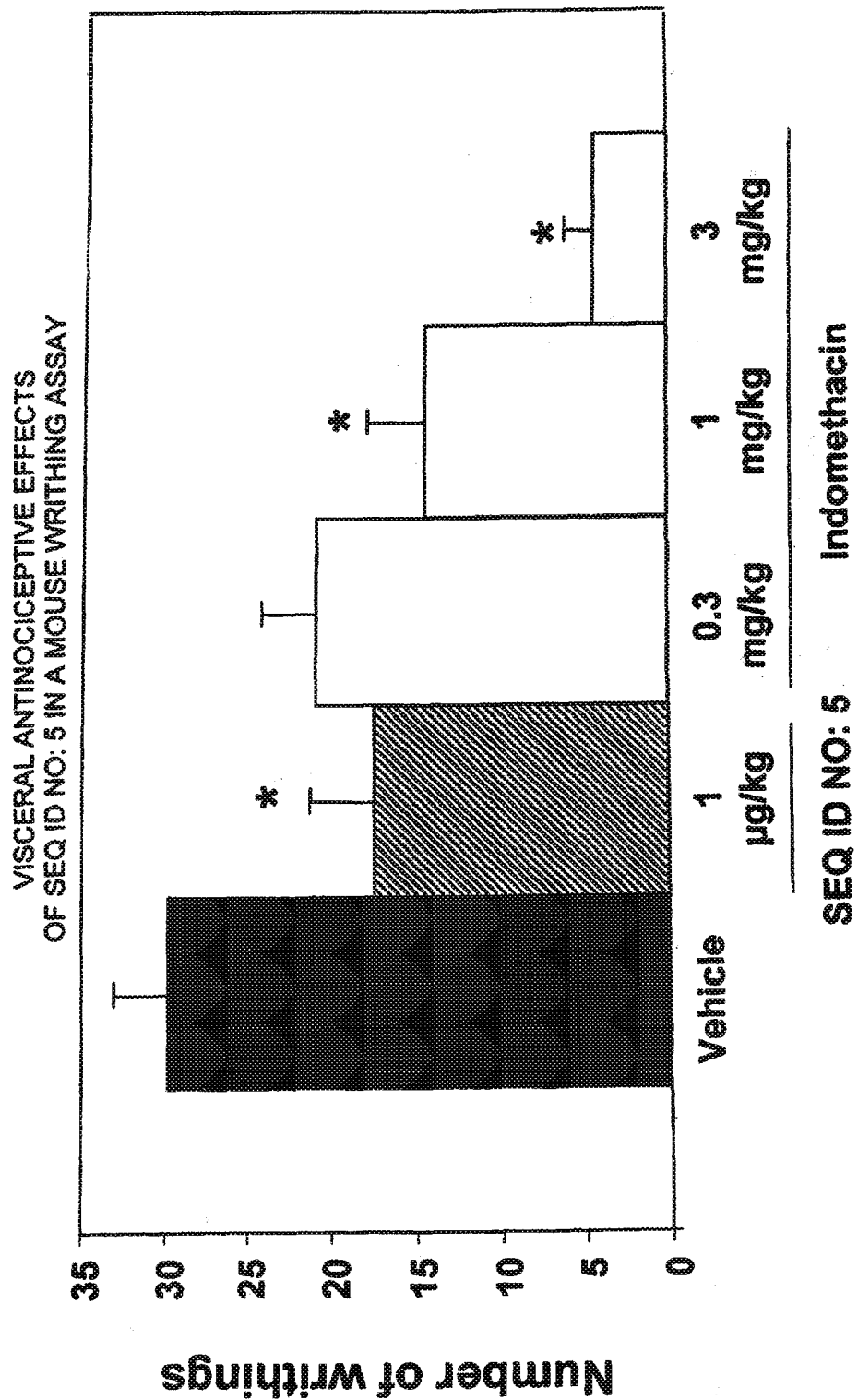
FIGS. 8A and 8B show the effects of differing doses of SEQ ID NO:5 and SEQ ID NO:3 in the PBQ writhing assay.
Figure 8B:
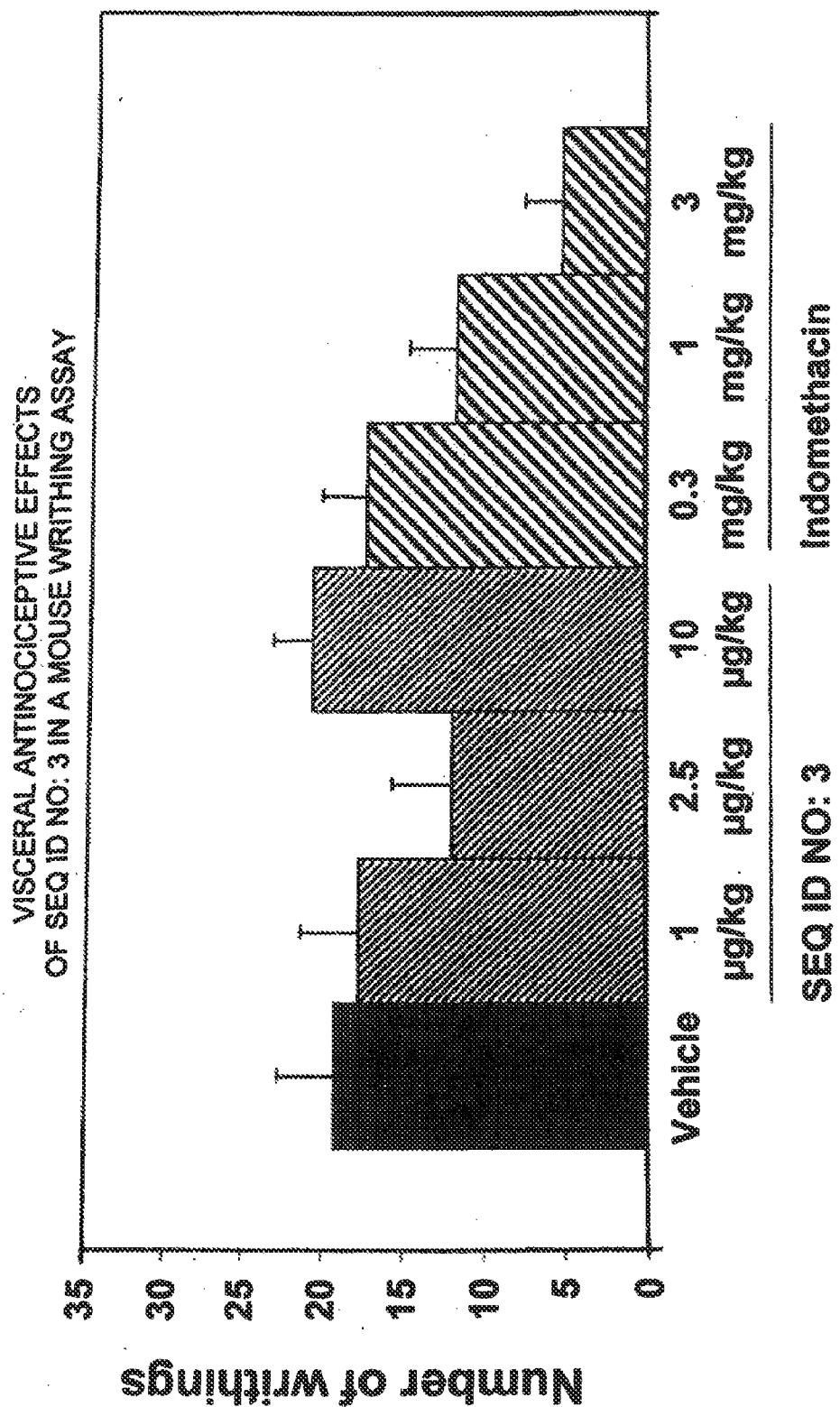

FIGS. 8a and 8b show the effect of different doses of SEQ ID NO:5 and SEQ ID NO:3 in the PBQ writhing assay. Indomethacin, an NSAID (nonsteroidal anti-inflammatory drug) with known pain control activity, was used as the positive control in the assay. Significant reductions in writhings were observed for SEQ ID NO:5 (1 mg/kg dose) and SEQ ID NO:3 (2.5 mg/kg dose) compared to the vehicle control. Loss of efficacy at the highest dose tested has also been observed for multiple other compounds (such as 5HT-3 antagonists) tested in similar assays. The results of this study suggest that both SEQ ID NO:5 and SEQ ID NO:3 have antinociceptive effects in this visceral pain model comparable to the intermediate doses of indomethacin.

Example 5

SEQ ID NO:3 Kd Determination

To determine the affinity of SEQ ID NO:3 for GC-C receptors found in rat intestinal mucosa, a competition binding assay was performed using rate intestinal epithelial cells. Epithelial cells from the small intestine of rats were obtained as described by Kessler et al. (*J. Biol. Chem.* 245: 5281-5288 (1970)). Briefly, animals were sacrificed and their abdominal cavities exposed. The small intestine was rinsed with 300 ml ice cold saline or PBS. 10 cm of the small intestine measured at 10 cm from the pylorus was removed and cut into 1 inch segments. Intestinal mucosa was extruded from the intestine by gentle pressure between a piece of parafilm and a P-1000 pipette tip. Intestinal epithelial cells were placed in 2 ml PBS and pipetted up and down with a 5 ml pipette to make a suspension of cells. Protein concentration in the suspension was measured using the Bradford method (*Anal. Biochem.* 72: 248-254 (1976)).

Figure 9:
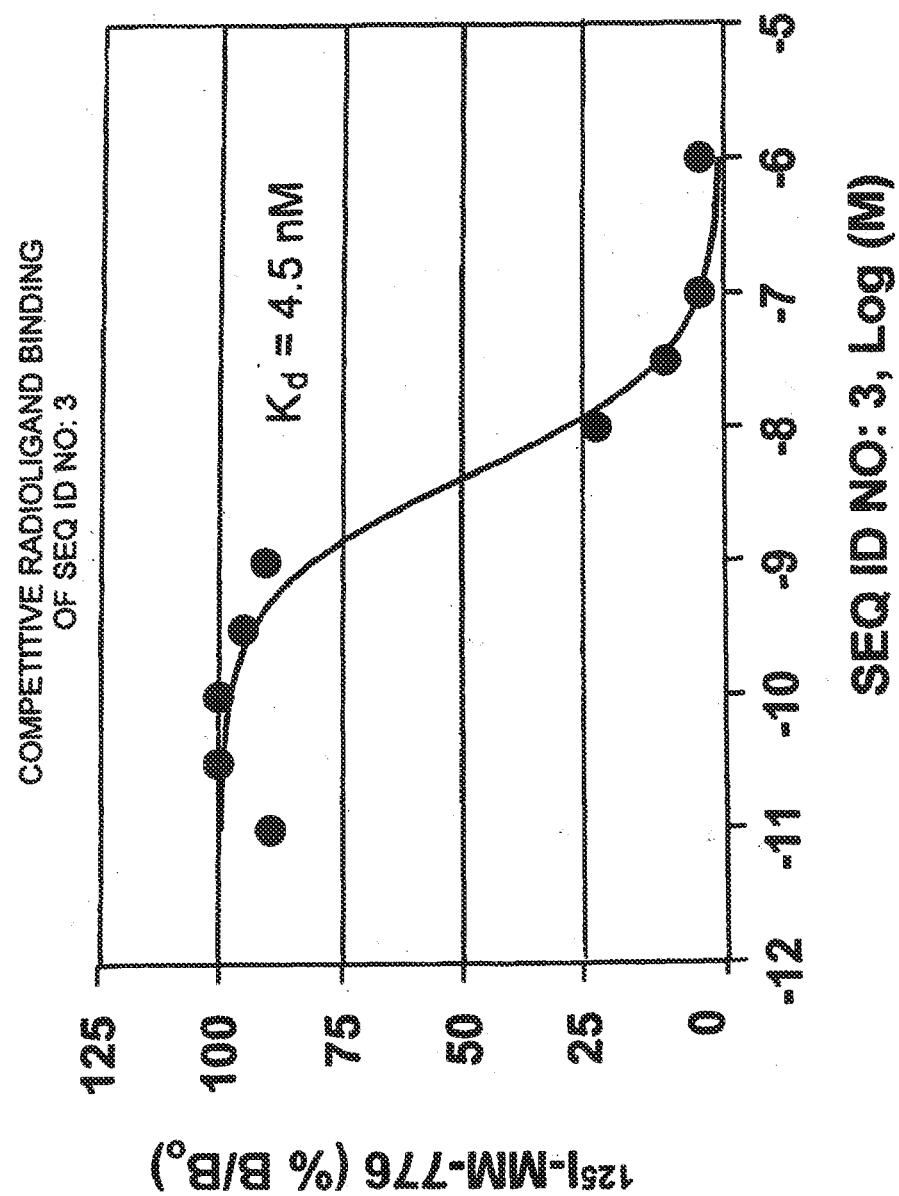
FIG. 9 shows the results of Kd determination analysis using SEQ ID NO:3 in a competitive radioligand binding assay.

A competition binding assay was performed based on the method of Giannella et al. (*Am. J. Physiol.* 245: G492-G498) between [$^{125}$I] labeled SEQ ID NO:4 and SEQ ID NO:3. The assay mixture contained: 0.5 ml of DME with 20 mM HEPES-KOH pH 7.0, 0.9 mg of the cell suspension listed above, 21.4 fmol [$^{125}$I]-SEQ ID NO:4 (42.8 pM), and different concentrations of competitor SEQ ID NO:3 (0.01 to 1000 nM). The mixture was incubated at room temperature for 1 hour, and the reaction stopped by applying the mixture to GF/B glass-fiber filters (Whatman). The filters were washed with 5 ml ice-cold PBS and radioactivity was measured. FIG. 9 shows that the Kd for SEQ ID NO:3 in this assay is 4.5 nm. % B/Bo is the percentage of the ratio of radioactivity trapped in each sample (B) compared to the radioactivity retained in a control sample with no cold competitor (Bo). Giannella et al. (*Am. J. Physiol.* 245: G492-G498) observed that the Kd for wild-type ST peptide in this same assay was ~13 nm.

Example 6

Pharmacokinetic Properties of SEQ ID NO:3

Figure 10A:
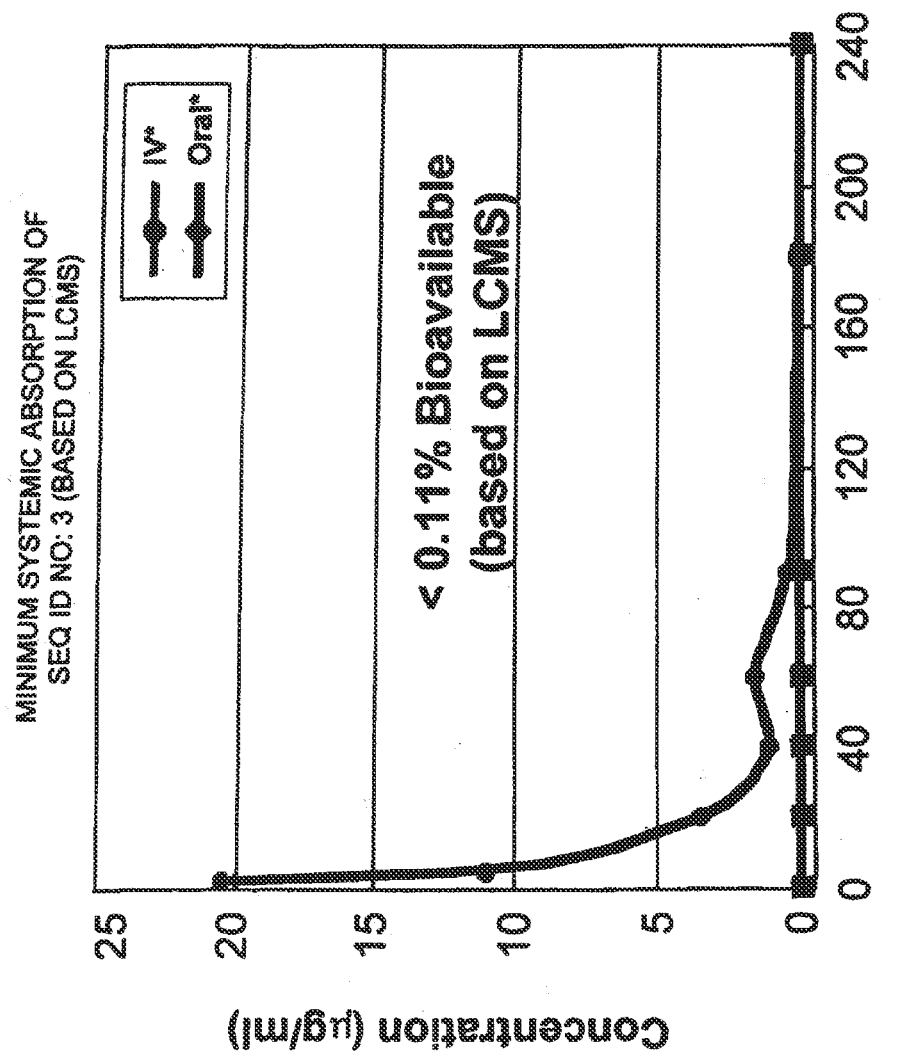

To study the pharmacokinetics of SEQ ID NO:3, absorbability studies in mice were performed by administering SEQ ID NO:3 intravaneously via tail vein injection or orally by gavage to 8-week-old CD1 mice. Serum was collected from the animals at various time points and tested for the presence of SEQ ID NO:3 using a competitive enzyme-linked immunoabsorbent assay (Oxoid, ST EIA kit, Cat#TD0700). The assay utilized monoclonal antibodies against ST peptide (antibodies are provided in the Oxoid kit) and synthetically manufactured SEQ ID NO:3. FIG. 10a shows absorption data for intravenously and orally administered SEQ ID NO:3 as detected by the ELISA assay. SEQ ID NO:3 appears to be minimally systemically absorbed and is <2.2% bioavailable.

A similar bioavailability study was performed in which LCMS rather than ELISA was used to detect SEQ ID NO:3. Initially, serum samples were extracted from the whole blood of exposed and control mice, then injected directly (10 mL) onto an in-line solid phase extraction (SPE) column (Waters Oasis HLB 25 mm column, 2.0×15 mm direct connect) without further processing. The sample on the SPE column was washed with a 5% methanol, 95% dH$_2$O solution (2.1 mL/min, 1.0 minute), then loaded onto an analytical column using a valve switch that places the SPE column in an inverted flow path onto the analytical column (Waters Xterra MS C8 5 mm IS column, 2.1×20 mm). The sample was eluted from the analytical column with a reverse phase gradient (Mobile Phase A: 10 mM ammonium hydroxide in dH$_2$O, Mobile Phase B: 10 mM ammonium hydroxide in 80% acetonitrile and 20% methanol; 20% B for the first 3 minutes then ramping to 95% B over 4 min. and holding for 2 min., all at a flow rate of 0.4 mL/min.). At 9.1 minutes, the gradient returns to the initial conditions of 20% B for 1 min. SEQ ID NO:3 eluted from the analytical column at 1.45 minutes, and was detected by triple-quadrapole mass spectrometry (MRM, 764 (+2 charge state)>182 (+1 charge state) Da; cone voltage=30V; collision=20 eV; parent resolution=2 Da at base peak; daughter resolution=2 Da at base peak). Instrument response was converted into concentration units by comparison with a standard curve using known amounts of chemically synthesized SEQ ID NO:3 prepared and injected in mouse serum using the same procedure.

FIG. 10b shows absorption data for IV and orally administered SEQ ID NO:3 as detected by LCMS. In this assay, SEQ ID NO:3 appears similarly minimally systemically absorbed and is <0.11% bioavailable.

Administration of Peptides and GC-C Receptor Agonists

For treatment of gastrointestinal disorders, the peptides and agonists of the invention are preferably administered orally, e.g., as a tablet or cachet containing a predetermined amount of the active ingredient, pellet, gel, paste, syrup, bolus, electuary, slurry, sachet; capsule; powder; lyophilized powder; granules; as a solution or a suspension in an aqueous liquid or a non-aqueous liquid; as an oil-in-water liquid emulsion or a water-in-oil liquid emulsion, via a liposomal formulation (see, e.g., EP 736299) or in some other form. Orally administered compositions can include binders, lubricants, inert diluents, lubricating, surface active or dispersing agents, flavoring agents, and humectants. Orally administered formulations such as tablets may optionally be coated or scored and may be formulated so as to provide sustained, delayed or controlled release of the active ingredient therein. The peptides and agonists can be co-administered with other agents used to treat gastrointestinal disorders including but not limited to the agents described herein. The peptides and agonists can also be administered by rectal suppository. For the treatment of disorders outside the gastrointestinal tract such as congestive heart failure and benign prostatic hypertrophy, peptides and agonists are preferably administered parenterally or orally.

The peptides described herein can be administered alone or in combination with other agents. For example, the peptides can be administered together with an analgesic peptide or compound. The analgesic peptide or compound can be covalently attached to a peptide described herein or it can be a separate agent that is administered together with or sequentially with a peptide described herein in a combination therapy.

Combination therapy can be achieved by administering two or more agents, e.g., a peptide described herein and an analgesic peptide or compound, each of which is formulated and administered separately, or by administering two or more agents in a single formulation. Other combinations are also encompassed by combination therapy. For example, two agents can be formulated together and administered in conjunction with a separate formulation containing a third agent. While the two or more agents in the combination therapy can be administered simultaneously, they need not be. For example, administration of a first agent (or combination of agents) can precede administration of a second agent (or combination of agents) by minutes, hours, days, or weeks. Thus, the two or more agents can be administered within minutes of each other or within 1, 2, 3, 6, 9, 12, 15, 18, or 24 hours of each other or within 1, 2, 3, 4, 5, 6, 7, 8, 9, 10, 12, 14 days of each other or within 2, 3, 4, 5, 6, 7, 8, 9, or 10 weeks of each other. In some cases even longer intervals are possible. While in many cases it is desirable that the two or more agents used in a combination therapy be present in within the patient's body at the same time, this need not be so.

Combination therapy can also include two or more administrations of one or more of the agents used in the combination. For example, if agent X and agent Y are used in a combination, one could administer them sequentially in any combination one or more times, e.g., in the order X-Y-X, X-X-Y, Y-X-Y, Y-Y-X, X-X-Y-Y, etc.

The agents, alone or in combination, can be combined with any pharmaceutically acceptable carrier or medium. Thus, they can be combined with materials that do not produce an adverse, allergic or otherwise unwanted reaction when administered to a patient. The carriers or mediums used can include solvents, dispersants, coatings, absorption promoting agents, controlled release agents, and one or more inert excipients (which include starches, polyols, granulating agents, microcrystalline cellulose, diluents, lubricants, binders, disintegrating agents, and the like), etc. If desired, tablet dosages of the disclosed compositions may be coated by standard aqueous or nonaqueous techniques.

Compositions of the present invention may also optionally include other therapeutic ingredients, anti-caking agents, preservatives, sweetening agents, colorants, flavors, desiccants, plasticizers, dyes, and the like. Any such optional ingredient must be compatible with the compound of the invention to insure the stability of the formulation. The composition may contain other additives as needed, including for example lactose, glucose, fructose, galactose, trehalose, sucrose, maltose, raffinose, maltitol, melezitose, stachyose, lactitol, palatinite, starch, xylitol, mannitol, myoinositol, and the like, and hydrates thereof, and amino acids, for example alanine, glycine and betaine, and peptides and proteins, for example albumen.

Examples of excipients for use as the pharmaceutically acceptable carriers and the pharmaceutically acceptable inert carriers and the aforementioned additional ingredients include, but are not limited to binders, fillers, disintegrants, lubricants, anti-microbial agents, and coating agents such as:

BINDERS: corn starch, potato starch, other starches, gelatin, natural and synthetic gums such as acacia, sodium alginate, alginic acid, other alginates, powdered tragacanth, guar gum, cellulose and its derivatives (e.g., ethyl cellulose, cellulose acetate, carboxymethyl cellulose calcium, sodium carboxymethyl cellulose), polyvinyl pyrrolidone, methyl cellulose, pre-gelatinized starch (e.g., STARCH 1500® and STARCH 1500 LM®, sold by Colorcon, Ltd.), hydroxypropyl methyl cellulose, microcrystalline cellulose (e.g. AVICEL™, such as, AVICEL-PH-101™, -13™ and -105™, sold by FMC Corporation, Marcus Hook, Pa., USA), or mixtures thereof, FILLERS: talc, calcium carbonate (e.g., granules or powder), dibasic calcium phosphate, tribasic calcium phosphate, calcium sulfate (e.g., granules or powder), microcrystalline cellulose, powdered cellulose, dextrates, kaolin, mannitol, silicic acid, sorbitol, starch, pre-gelatinized starch, or mixtures thereof, DISINTEGRANTS: agar-agar, alginic acid, calcium carbonate, microcrystalline cellulose, croscarmellose sodium, crospovidone, polacrilin potassium, sodium starch glycolate, potato or tapioca starch, other starches, pre-gelatinized starch, clays, other algins, other celluloses, gums, or mixtures thereof, LUBRICANTS: calcium stearate, magnesium stearate, mineral oil, light mineral oil, glycerin, sorbitol, mannitol, polyethylene glycol, other glycols, stearic acid, sodium lauryl sulfate, talc, hydrogenated vegetable oil (e.g., peanut oil, cottonseed oil, sunflower oil, sesame oil, olive oil, corn oil and soybean oil), zinc stearate, ethyl oleate, ethyl laurate, agar, syloid silica gel (AEROSIL 200, W.R. Grace Co., Baltimore, Md. USA), a coagulated aerosol of synthetic silica (Deaussa Co., Plano, Tex. USA), a pyrogenic silicon dioxide (CAB-O-SIL, Cabot Co., Boston, Mass. USA), or mixtures thereof, ANTI-CAKING AGENTS: calcium silicate, magnesium silicate, silicon dioxide, colloidal silicon dioxide, talc, or mixtures thereof, ANTIMICROBIAL AGENTS: benzalkonium chloride, benzethonium chloride, benzoic acid, benzyl alcohol, butyl paraben, cetylpyridinium chloride, cresol, chlorobutanol, dehydroacetic acid, ethylparaben, methylparaben, phenol, phenylethyl alcohol, phenoxyethanol, phenylmercuric acetate, phenylmercuric nitrate, potassium sorbate, propylparaben, sodium benzoate, sodium dehydroacetate, sodium propionate, sorbic acid, thimersol, thymo, or mixtures thereof, and COATING AGENTS: sodium carboxymethyl cellulose, cellulose acetate phthalate, ethylcellulose, gelatin, pharmaceutical glaze, hydroxypropyl cellulose, hydroxypropyl methylcellulose, hydroxypropyl methyl cellulose phthalate, methylcellulose, polyethylene glycol, polyvinyl acetate phthalate, shellac, sucrose, titanium dioxide, carnauba wax, microcrystalline wax, or mixtures thereof.

The agents either in their free form or as a salt can be combined with a polymer such as polylactic-glycoloic acid (PLGA), poly-(I)-lactic-glycolic-tartaric acid (P(I)LGT) (WO 01/12233), polyglycolic acid (U.S. Pat. No. 3,773,919), polylactic acid (U.S. Pat. No. 4,767,628), poly(ε-caprolactone) and poly(alkylene oxide) (U.S. 20030068384) to create a sustained release formulation. Such formulations can be used to implants that release a peptide or another agent over a period of a few days, a few weeks or several months depending on the polymer, the particle size of the polymer, and the size of the implant (see, e.g., U.S. Pat. No. 6,620,422). Other sustained release formulations and polymers for use in are described in EP 0 467 389 A2, WO 93/24150, U.S. Pat. No. 5,612,052, WO 97/40085, WO 03/075887, WO 01/01964A2, U.S. Pat. No. 5,922,356, WO 94/155587, WO 02/074247A2, WO 98/25642, U.S. Pat. No. 5,968,895, U.S. Pat. No. 6,180, 608, U.S. 20030171296, U.S. 20020176841, U.S. Pat. No. 5,672,659, U.S. Pat. No. 5,893,985, U.S. Pat. No. 5,134,122, U.S. Pat. No. 5,192,741, U.S. Pat. No. 5,192,741, U.S. Pat. No. 4,668,506, U.S. Pat. No. 4,713,244, U.S. Pat. No. 5,445, 832 U.S. Pat. No. 4,931,279, U.S. Pat. No. 5,980,945, WO 02/058672, WO 9726015, WO 97/04744, and. US20020019446. In such sustained release formulations microparticles of peptide are combined with microparticles of polymer. One or more sustained release implants can be placed in the large intestine, the small intestine or both. U.S. Pat. No. 6,011,011 and WO 94/06452 describe a sustained release formulation providing either polyethylene glycols (i.e. PEG 300 and PEG 400) or triacetin. WO 03/053401 describes a formulation which may both enhance bioavailability and provide controlled release of the agent within the GI tract. Additional controlled release formulations are described in WO 02/38129, EP 326 151, U.S. Pat. No. 5,236,704, WO 02/30398, WO 98/13029; U.S. 20030064105, U.S. 20030138488A1, U.S. 20030216307A1, U.S. Pat. No. 6,667,060, WO 01/49249, WO 01/49311, WO 01/49249, WO 01/49311, and U.S. Pat. No. 5,877,224.

The agents can be administered, e.g., by intravenous injection, intramuscular injection, subcutaneous injection, intraperitoneal injection, topical, sublingual, intraarticular (in the joints), intradermal, buccal, ophthalmic (including intraocular), intranasaly (including using a cannula), intraspinally, intrathecally, or by other routes. The agents can be administered orally, e.g., as a tablet or cachet containing a predetermined amount of the active ingredient, gel, pellet, paste, syrup, bolus, electuary, slurry, capsule, powder, lyophilized powder, granules, sachet, as a solution or a suspension in an aqueous liquid or a non-aqueous liquid, as an oil-in-water liquid emulsion or a water-in-oil liquid emulsion, via a micellar formulation (see, e.g. WO 97/11682) via a liposomal formulation (see, e.g., EP 736299, WO 99/59550 and WO 97/13500), via formulations described in WO 03/094886 or in some other form. Orally administered compositions can include binders, lubricants, inert diluents, lubricating, surface active or dispersing agents, flavoring agents, and humectants. Orally administered formulations such as tablets may optionally be coated or scored and may be formulated so as to provide sustained, delayed or controlled release of the active ingredient therein. The agents can also be administered transdermally (i.e. via reservoir-type or matrix-type patches, microneedles, thermal poration, hypodermic needles, iontophoresis, electroporation, ultrasound or other forms of sonophoresis, jet injection, or a combination of any of the preceding methods (Prausnitz et al. 2004, Nature Reviews Drug Discovery 3:115-124)). The agents can be administered using high-velocity transdermal particle injection techniques using the hydrogel particle formulation described in U.S. 20020061336. Additional particle formulations are described in WO 00/45792, WO 00/53160, and WO 02/19989. An example of a transdermal formulation containing plaster and the absorption promoter dimethylisosorbide can be found in WO 89/04179. WO 96/11705 provides formulations suitable for transdermal administration. The agents can be administered in the form a suppository or by other vaginal or rectal means. The agents can be administered in a transmembrane formulation as described in WO 90/07923. The agents can be administered non-invasively via the dehydrated participles described in U.S. Pat. No. 6,485,706. The agent can be administered in an enteric-coated drug formulation as described in WO 02/49621. The agents can be administered intranasally using the formulation described in U.S. Pat. No. 5,179,079. Formulations suitable for parenteral injection are described in WO 00/62759. The agents can be administered using the casein formulation described in U.S. 20030206939 and WO 00/06108. The agents can be administered using the particulate formulations described in U.S. 20020034536.

The agents, alone or in combination with other suitable components, can be administered by pulmonary route utilizing several techniques including but not limited to intratracheal instillation (delivery of solution into the lungs by syringe), intratracheal delivery of liposomes, insufflation (administration of powder formulation by syringe or any other similar device into the lungs) and aerosol inhalation. Aerosols (e.g., jet or ultrasonic nebulizers, metered-dose inhalers (MDIs), and dry-powder inhalers (DPIs)) can also be used in intranasal applications. Aerosol formulations are stable dispersions or suspensions of solid material and liquid droplets in a gaseous medium and can be placed into pressurized acceptable propellants, such as hydrofluoroalkanes (HFAs, i.e. HFA-134a and HFA-227, or a mixture thereof), dichlorodifluoromethane (or other chlorofluocarbon propellants such as a mixture of Propellants 11, 12, and/or 114), propane, nitrogen, and the like. Pulmonary formulations may include permeation enhancers such as fatty acids, and saccharides, chelating agents, enzyme inhibitors (e.g., protease inhibitors), adjuvants (e.g., glycocholate, surfactin, span 85, and nafamostat), preservatives (e.g., benzalkonium chloride or chlorobutanol), and ethanol (normally up to 5% but possibly up to 20%, by weight). Ethanol is commonly included in aerosol compositions as it can improve the function of the metering valve and in some cases also improve the stability of the dispersion. Pulmonary formulations may also include surfactants which include but are not limited to bile salts and those described in U.S. Pat. No. 6,524,557 and references therein. The surfactants described in U.S. Pat. No. 6,524,557, e.g., a C8-C16 fatty acid salt, a bile salt, a phospholipid, or alkyl saccharide are advantageous in that some of them also reportedly enhance absorption of the peptide in the formulation. Also suitable in the invention are dry powder formulations comprising a therapeutically effective amount of active compound blended with an appropriate carrier and adapted for use in connection with a dry-powder inhaler. Absorption enhancers which can be added to dry powder formulations of the present invention include those described in U.S. Pat. No. 6,632,456. WO 02/080884 describes new methods for the surface modification of powders. Aerosol formulations may include U.S. Pat. No. 5,230,884, U.S. Pat. No. 5,292,499, WO 017/8694, WO 01/78696, U.S. 2003019437, U.S. 20030165436, and WO 96/40089 (which includes vegetable oil). Sustained release formulations suitable for inhalation are described in U.S. 20010036481A1, 20030232019A1, and U.S. 20040018243A1 as well as in WO 01/13891, WO 02/067902, WO 03/072080, and WO 03/079885. Pulmonary formulations containing microparticles are described in WO 03/015750, U.S. 20030008013, and WO 00/00176. Pulmonary formulations containing stable glassy state powder are described in U.S. 20020141945 and U.S. Pat. No. 6,309,671. Other aerosol formulations are described in EP 1338272A1 WO 90/09781, U.S. Pat. No. 5,348,730, U.S. Pat. No. 6,436,367, WO 91/04011, and U.S. Pat. No. 6,294,153 and U.S. Pat. No. 6,290,987 describes a liposomal based formulation that can be administered via aerosol or other means. Powder formulations for inhalation are described in U.S. 20030053960 and WO 01/60341. The agents can be administered intranasally as described in U.S. 20010038824.

Solutions of medicament in buffered saline and similar vehicles are commonly employed to generate an aerosol in a nebulizer. Simple nebulizers operate on Bernoulli's principle and employ a stream of air or oxygen to generate the spray particles. More complex nebulizers employ ultrasound to create the spray particles. Both types are well known in the art and are described in standard textbooks of pharmacy such as Sprowls' American Pharmacy and Remington's The Science and Practice of Pharmacy. Other devices for generating aerosols employ compressed gases, usually hydrofluorocarbons and chlorofluorocarbons, which are mixed with the medicament and any necessary excipients in a pressurized container, these devices are likewise described in standard textbooks such as Sprowls and Remington.

The agents can be a free acid or base, or a pharmacologically acceptable salt thereof. Solids can be dissolved or dispersed immediately prior to administration or earlier. In some circumstances the preparations include a preservative to prevent the growth of microorganisms. The pharmaceutical forms suitable for injection can include sterile aqueous or organic solutions or dispersions which include, e.g., water, an alcohol, an organic solvent, an oil or other solvent or dispersant (e.g., glycerol, propylene glycol, polyethylene glycol, and vegetable oils). The formulations may contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. Pharmaceutical agents can be sterilized by filter sterilization or by other suitable means. The agent can be fused to immunoglobulins or albumin, or incorporated into a liposome to improve half-life. The agent can also be conjugated to polyethylene glycol (PEG) chains. Methods for pegylation and additional formulations containing PEG-conjugates (i.e. PEG-based hydrogels, PEG modified liposomes) can be found in Harris and Chess, Nature Reviews Drug Discovery 2: 214-221 and the references therein. Peptides can also be modified with alkyl groups (e.g., C1-C20 straight or branched alkyl groups); fatty acid radicals; and combinations of PEG, alkyl groups and fatty acid radicals (see U.S. Pat. No. 6,309,633; Soltero et al., 2001 Innovations in Pharmaceutical Technology 106-110). The agent can be administered via a nanocochleate or cochleate delivery vehicle (BioDelivery Sciences International). The agents can be delivered transmucosally (i.e. across a mucosal surface such as the vagina, eye or nose) using formulations such as that described in U.S. Pat. No. 5,204,108. The agents can be formulated in microcapsules as described in WO 88/01165. The agent can be administered intra-orally using the formulations described in U.S. 20020055496, WO 00/47203, and U.S. Pat. No. 6,495,120. The agent can be delivered using nanoemulsion formulations described in WO 01/91728A2.

Suitable pharmaceutical compositions in accordance with the invention will generally include an amount of the active compound(s) with an acceptable pharmaceutical diluent or excipient, such as a sterile aqueous solution, to give a range of final concentrations, depending on the intended use. The techniques of preparation are generally well known in the art, as exemplified by Remington's Pharmaceutical Sciences (18th Edition, Mack Publishing Company, 1995).

The agents described herein and combination therapy agents can be packaged as a kit that includes single or multiple doses of two or more agents, each packaged or formulated individually, or single or multiple doses of two or more agents packaged or formulated in combination. Thus, one or more agents can be present in first container, and the kit can optionally include one or more agents in a second container. The container or containers are placed within a package, and the package can optionally include administration or dosage instructions. A kit can include additional components such as syringes or other means for administering the agents as well as diluents or other means for formulation.

Methods to increase chemical and/or physical stability of the agents the described herein are found in U.S. Pat. No. 6,541,606, U.S. Pat. No. 6,068,850, U.S. Pat. No. 6,124,261, U.S. Pat. No. 5,904,935, and WO 00/15224, U.S. 20030069182 (via the addition of nicotinamide), U.S. 20030175230A1, U.S. 20030175230A1, U.S. 20030175239A1, U.S. 20020045582, U.S. 20010031726, WO 02/26248, WO 03/014304, WO 98/00152A1, WO 98/00157A1, WO 90/12029, WO 00/04880, and WO 91/04743, WO 97/04796 and the references cited therein.

Methods to increase bioavailability of the agents described herein are found in U.S. Pat. No. 6,008,187, U.S. Pat. No. 5,424,289, U.S. 20030198619, WO 90/01329, WO 01/49268, WO 00/32172, and WO 02/064166. Glycyrrhizinate can also be used as an absorption enhancer (see, e.g., EP397447). WO 03/004062 discusses Ulex europaeus I (UEA1) and UEAI mimetics which may be used to target the agents of the invention to the GI tract.

The agents described herein can be fused to a modified version of the blood serum protein transferrin. U.S. 20030221201, U.S. 20040023334, U.S. 20030226155, WO 04/020454, and WO 04/019872 discuss the manufacture and use of transferrin fusion proteins. Transferrin fusion proteins may improve circulatory half life and efficacy, decrease undesirable side effects and allow reduced dosage.

The peptides and agonists of the invention can be recombinantly expressed in bacteria. Bacteria expressing the peptide or agonists can be administered orally, rectally, mucosally or in via some other mode of administration including but not limited to those described herein.

Analgesic Agents in Combitherapy

The peptides and agonists described herein can be used in combination therapy with an analgesic agent, e.g., an analgesic compound or an analgesic peptide. These peptides and compounds can be administered with the peptides of the invention (simultaneously or sequentially). They can also be optionally covalently linked or attached to an agent described herein to create therapeutic conjugates. Among the useful analgesic agents are: Ca channel blockers, 5HT receptor antagonists (for example 5HT3, 5HT4 and 5HT1 receptor antagonists), opioid receptor agonists (loperamide, fedotozine, and fentanyl), NK1 receptor antagonists, CCK receptor agonists (e.g., loxiglumide), NK1 receptor antagonists, NK3 receptor antagonists, norepinephrine-serotonin reuptake inhibitors (NSRI), vanilloid and cannabanoid receptor agonists, and sialorphin. Analgesics agents in the various classes are described in the literature.

Among the useful analgesic peptides are sialorphin-related peptides, including those comprising the amino acid sequence QHNPR (SEQ ID NO:1661), including: VQHNPR (SEQ ID NO:1662); VRQHNPR (SEQ ID NO:1663); VRGQHNPR (SEQ ID NO:1664); VRGPQHNPR (SEQ ID NO:1665); VRGPRQHNPR (SEQ ID NO:1666); VRG-PRRQHNPR (SEQ ID NO:1667); and RQHNPR (SEQ ID NO:1668). Sialorphin-related peptides bind to neprilysin and inhibit neprilysin-mediated breakdown of substance P and Met-enkephalin. Thus, compounds or peptides that are inhibitors of neprilysin are useful analgesic agents which can be administered with the peptides of the invention in a co-therapy or linked to the peptides of the invention, e.g., by a covalent bond. Sialophin and related peptides are described in U.S. Pat. No. 6,589,750; U.S. 20030078200 A1; and WO 02/051435 A2.

Opioid receptor antagonists and agonists can be administered with the peptides of the invention in co-therapy or linked to the agent of the invention, e.g., by a covalent bond. For example, opioid receptor antagonists such as naloxone, naltrexone, methyl nalozone, nalmefene, cypridime, beta funaltrexamine, naloxonazine, naltrindole, and norbinaltorphimine are thought to be useful in the treatment of IBS. It can be useful to formulate opioid antagonists of this type is a delayed and sustained release formulation such that initial release of the antagonist is in the mid to distal small intestine and/or ascending colon. Such antagonists are described in WO 01/32180 A2. Enkephalin pentapeptide (HOE825; Tyr-D-Lys-Gly-Phe-L-homoserine) is an agonist of the mu and delta opioid receptors and is thought to be useful for increasing intestinal motility (*Eur. J. Pharm.* 219:445, 1992), and this peptide can be used in conjunction with the peptides of the invention. Also useful is trimebutine which is thought to bind to mu/delta/kappa opioid receptors and activate release of motilin and modulate the release of gastrin, vasoactive intestinal peptide, gastrin and glucagons. Kappa opioid receptor agonists such as fedotozine, asimadoline, and ketocyclazocine, and compounds described in WO 03/097051 A2 can be used with or linked to the peptides of the invention. In addition, mu opioid receptor agonists such as morphine, diphenyloxylate, frakefamide (H-Tyr-D-Ala-Phe(F)-Phe-NH$_2$; WO 01/019849 A1) and loperamide can be used.

Tyr-Arg (kyotorphin) is a dipeptide that acts by stimulating the release of met-enkephalins to elicit an analgesic effect (*J. Biol. Chem.* 262:8165, 1987). Kyotorphin can be used with or linked to the peptides of the invention.

Chromogranin-derived peptide (CgA 47-66; see, e.g., Ghia et al. 2004 Regulatory Peptides 119:199) can be used with or linked to the peptides of the invention.

CCK receptor agonists such as caerulein from amphibians and other species are useful analgesic agents that can be used with or linked to the peptides of the invention.

Conotoxin peptides represent a large class of analgesic peptides that act at voltage gated Ca channels, NMDA receptors or nicotinic receptors. These peptides can be used with or linked to the peptides of the invention.

Peptide analogs of thymulin (FR Application 2830451) can have analgesic activity and can be used with or linked to the peptides of the invention.

CCK (CCKa or CCKb) receptor antagonists, including loxiglumide and dexloxiglumide (the R-isomer of loxiglumide) (WO 88/05774) can have analgesic activity and can be used with or linked to the peptides of the invention.

Other useful analgesic agents include 5-HT4 agonists such as tegaserod (Zelnorm®), mosapride, metoclopramide, zacopride, cisapride, renzapride, benzimidazolone derivatives such as BIMU 1 and BIMU 8, and lirexapride. Such agonists are described in: EP1321142 A1, WO 03/053432A1, EP 505322 A1, EP 505322 B1, U.S. Pat. No. 5,510,353, EP 507672 A1, EP 507672 B1, and U.S. Pat. No. 5,273,983.

Calcium channel blockers such as ziconotide and related compounds described in, for example, EP625162B1, U.S. Pat. No. 5,364,842, U.S. Pat. No. 5,587,454, U.S. Pat. No. 5,824,645, U.S. Pat. No. 5,859,186, U.S. Pat. No. 5,994,305, U.S. Pat. No. 6,087,091, U.S. Pat. No. 6,136,786, WO 93/13128 A1, EP 1336409 A1, EP 835126 A1, EP 835126 B1, U.S. Pat. No. 5,795,864, U.S. Pat. No. 5,891,849, U.S. Pat. No. 6,054,429, WO 97/01351 A1, can be used with or linked to the peptides of the invention.

Various antagonists of the NK-1, NK-2, and NK-3 receptors (for a review see Giardina et al. 2003 *Drugs* 6:758) can be can be used with or linked to the peptides of the invention.

NK1 receptor antagonists such as: aprepitant (Merck & Co Inc), vofopitant, ezlopitant (Pfizer, Inc.), R-673 (Hoffmann-La Roche Ltd), SR-48968 (Sanofi Synthelabo), CP-122,721 (Pfizer, Inc.), GW679769 (Glaxo Smith Kline), TAK-637 (Takeda/Abbot), SR-14033, and related compounds described in, for example, EP 873753 A1, US 20010006972 A1, US 20030109417 A1, WO 01/52844 A1, can be used with or linked to the peptides of the invention.

NK-2 receptor antagonists such as nepadutant (Menarini Ricerche SpA), saredutant (Sanofi-Synthelabo), GW597599 (Glaxo Smith Kline), SR-144190 (Sanofi-Synthelabo) and UK-290795 (Pfizer Inc) can be used with or linked to the peptides of the invention.

NK3 receptor antagonists such as osanetant (SR-142801; Sanofi-Synthelabo), SSR-241586, talnetant and related compounds described in, for example, WO 02/094187 A2, EP 876347 A1, WO 97/21680 A1, U.S. Pat. No. 6,277,862, WO 98/11090, WO 95/28418, WO 97/19927, and Boden et al. (*J Med Chem.* 39:1664-75, 1996) can be used with or linked to the peptides of the invention.

Norepinephrine-serotonin reuptake inhibitors (NSRI) such as milnacipran and related compounds described in WO 03/077897 A1 can be used with or linked to the peptides of the invention.

Vanilloid receptor antagonists such as arvanil and related compounds described in WO 01/64212 A1 can be used with or linked to the peptides of the invention.

The analgesic peptides and compounds can be administered with the peptides and agonists of the invention (simultaneously or sequentially). The analgesic agents can also be covalently linked to the peptides and agonists of the invention to create therapeutic conjugates. Where the analgesic is a peptide and is covalently linked to an agent described herein the resulting peptide may also include at least one trypsin cleavage site. When present within the peptide, the analgesic peptide may be preceded by (if it is at the carboxy terminus) or followed by (if it is at the amino terminus) a trypsin cleavage site that allows release of the analgesic peptide.

In addition to sialorphin-related peptides, analgesic peptides include: AspPhe, endomorphin-1, endomorphin-2, nocistatin, dalargin, lupron, ziconotide, and substance P.

Other Agents for Use in Combitherapy

Also within the invention are pharmaceutical compositions comprising a peptide or agonists of the invention and a second therapeutic agent. The second therapeutic agent can be administered to treat any condition for which it is useful, including conditions that are not considered to be the primary indication for treatment with the second therapeutic agent. The second therapeutic agent can be administered simultaneously or sequentially. The second therapeutic agent can be covalently linked to the peptides and agonists of the invention to create a therapeutic conjugate. When the second therapeutic agent is another peptide, a linker including those described herein may be used between the peptide of the invention and the second therapeutic peptide.

Examples of additional therapeutic agents to treat gastrointestinal and other disorders include:

(1) agents to treat constipation (e.g., a chloride channel activator such as the bicylic fatty acid, Lubiprostone (formerly known as SPI-0211; Sucampo Pharmaceuticals, Inc.; Bethesda, Md.), a laxative such as MiraLax; Braintree Laboratories, Braintree Mass.);

(2) acid reducing agents such as proton pump inhibitors (e.g., omeprazole (Prilosec®), esomeprazole (Nexium®), lansoprazole (Prevacid®), pantoprazole (Protonix®) and rabeprazole (Aciphex®)) and H1 stamine H2-receptor antagonist (also known as H2 receptor blockers including cimetidine, ranitidine, famotidine and nizatidine);

(3) prokinetic agents including metoclopramide (Reglan®), domperidone (Motilium®), erythromycin or cisapride (Propulsid®)

(4) pro-motility agents such as the vasostatin-derived peptide, chromogranin A (4-16) (see, e.g., Ghia et al. 2004 Regulatory Peptides 121:31) or motilin agonists (e.g., GM-611 or mitemcinal fumarate);

(5) complete or partial 5HT (e.g. 5HT1, 5HT2, 5HT3, 5HT4) receptor agonists or antagonists (including 5HT4 receptor agonists (such as tegaserod (ZELNORM®), mosapride, metoclopramide, zacopride, cisapride, renzapride, benzimidazolone derivatives such as BIMU 1 and BIMU 8, and lirexapride. Such agonists are described in: EP1321142 A1, WO 03/053432A1, EP 505322 A1, EP 505322 B1, U.S. Pat. No. 5,510,353, EP 507672 A1, EP 507672 B1, and U.S. Pat. No. 5,273,983); 5HT3 receptor agonists such as MKC-733; and 5HT3 receptor antagonists such as alosetron and ATI-7000 (Aryx Therapeutics, Santa Clara Calif.);
(6) muscarinic receptor agonists;
(7) anti-inflammatory agents;
(8) antispasmodics;
(9) antidepressants;
(10) centrally-acting analgesic agents such as opioid receptor agonists, opioid receptor antagonists (e.g., naltrexone);
(11) agents for the treatment of Inflammatory bowel disease;
(12) agents for the treatment of Crohn's disease and/or ulcerative colitis (e.g., alequel (Enzo Biochem, Inc.; Farmingsale, N.Y.), the anti-inflammatory peptide RDP58 (Genzyme, Inc.; Cambridge, Mass.), and TRAFICET-EN™ (ChemoCentryx, Inc.; San Carlos, Calif.);
(13) agents that treat gastrointestinal or visceral pain;
(14) PDE (phosphodiesterase) inhibitors including but not limited to those disclosed herein;
(15) purgatives that draw fluids to the intestine (e.g., VISICOL®, a combination of sodium phosphate monobasic monohydrate and sodium phosphate dibasic anhydrate);
(16) Corticotropin Releasing Factor (CRF) receptor antagonists (including NBI-34041 (Neurocrine Biosciences, San Diego, Calif.), CRH9-41, astressin, R121919 (Janssen Pharmaceutica), CP154,526, NBI-27914, Antalarmin, DMP696 (Bristol-Myers Squibb) CP-316,311 (Pfizer, Inc.), GW876008 (Neurocrine/Glaxo Smith Kline), ONO-2333Ms (Ono Pharmaceuticals), TS-041 (Janssen), AAG561 (Novartis) and those disclosed in U.S. Pat. No. 5,063,245, U.S. Pat. No. 5,861,398, US20040224964, US20040198726, US20040176400, US20040171607, US20040110815, and US20040006066);
(17) glucagon-like peptides (glp-1) and analogues thereof (including exendin-4) and inhibitors of DPP-IV (DPP-IV mediates the inactivation of glp-1);
(18) tofisopam, enantiomerically-pure R-tofisopam, and pharmaceutically-acceptable salts thereof (US 20040229867)
(19) the tricyclic anti-depressant of the dibenzothiazepine type, tianeptine (Stablon®) and other agents described in U.S. Pat. No. 6,683,072;
(20) (E)-4 (1,3bis(cyclohexylmethyl)-1,2,34,-tetrahydro-2,6-diono-9H-purin-8-yl)cinnamic acid nonaethylene glycol methyl ether ester and related compounds described in WO 02/067942; and
(21) the probiotic PROBACTRIX® (The BioBalance Corporation; New York, N.Y.) which contains microorganisms useful in the treatment of gastrointestinal disorders.

The peptides and agonists of the invention can be used in combination therapy with insulin and related compounds including primate, rodent, or rabbit insulin including biologically active variants thereof including allelic variants, more preferably human insulin available in recombinant form. Sources of human insulin include pharmaceutically acceptable and sterile formulations such as those available from Eli Lilly (Indianapolis, Ind. 46285) as Humulin™ (human insulin rDNA origin). See the THE PHYSICIAN'S DESK REFERENCE, 55.sup.th Ed. (2001) Medical Economics, Thomson Healthcare (disclosing other suitable human insulins). The peptides of the invention can also be used in combination therapy with agents that can boost insulin effects or levels of a subject upon administration, e.g. glipizide and/or rosiglitazone. The peptides and agonists of the invention can be used in combitherapy with SYMLIN® (pramlintide acetate) and Exenatide® (synthetic exendin-4; a 39 aa peptide).

The peptides and agonists of the invention can also be used in combination therapy with agents (e.g., Entereg™ (alvimopan; formerly called adolor/ADL 8-2698), conivaptan and related agents describe in U.S. Pat. No. 6,645,959) for the treatment of postoperative ileus.

The peptides and agonists of the invention can be used in combination therapy with an anti-hypertensive agent including but not limited to:
(1) diuretics, such as thiazides, including chlorthalidone, chlorthiazide, dichlorophenamide, hydroflumethiazide, indapamide, polythiazide, and hydrochlorothiazide; loop diuretics, such as bumetanide, ethacrynic acid, furosemide, and torsemide; potassium sparing agents, such as amiloride, and triamterene; and aldosterone antagonists, such as spironolactone, epirenone, and the like;
(2) beta-adrenergic blockers such as acebutolol, atenolol, betaxolol, bevantolol, bisoprolol, bopindolol, carteolol, carvedilol, celiprolol, esmolol, indenolol, metaprolol, nadolol, nebivolol, penbutolol, pindolol, propanolol, sotalol, tertatolol, tilisolol, and timolol, and the like;
(3) calcium channel blockers such as amlodipine, aranidipine, azelnidipine, barnidipine, benidipine, bepridil, cinaldipine, clevidipine, diltiazem, efonidipine, felodipine, gallopamil, isradipine, lacidipine, lemildipine, lercanidipine, nicardipine, nifedipine, nilvadipine, nimodepine, nisoldipine, nitrendipine, manidipine, pranidipine, and verapamil, and the like;
(4) angiotensin converting enzyme (ACE) inhibitors such as benazepril; captopril; ceranapril; cilazapril; delapril; enalapril; enalopril; fosinopril; imidapril; lisinopril; losinopril; moexipril; quinapril; quinaprilat; ramipril; perindopril; perindropril; quanipril; spirapril; tenocapril; trandolapril, and zofenopril, and the like;
(5) neutral endopeptidase inhibitors such as omapatrilat, cadoxatril and ecadotril, fosidotril, sampatrilat, AVE7688, ER4030, and the like;
(6) endothelin antagonists such as tezosentan, A308165, and YM62899, and the like;
(7) vasodilators such as hydralazine, clonidine, minoxidil, and nicotinyl alcohol, and the like;
(8) angiotensin II receptor antagonists such as aprosartan, candesartan, eprosartan, irbesartan, losartan, olmesartan, pratosartan, tasosartan, telmisartan, valsartan, and EXP-3137, F16828K, and RNH6270, and the like;
(9) α/β adrenergic blockers such as nipradilol, arotinolol and amosulalol, and the like;
(10) alpha 1 blockers, such as terazosin, urapidil, prazosin, tamsulosin, bunazosin, trimazosin, doxazosin, naftopidil, indoramin, WHP 164, and XEN010, and the like;
(11) alpha 2 agonists such as lofexidine, tiamenidine, moxonidine, rilmenidine and guanobenz, and the like;
(12) aldosterone inhibitors, and the like; and
(13) angiopoietin-2-binding agents such as those disclosed in WO03/030833.

The peptides and agonists of the invention can be used in combination therapy with one or more of the following agents useful in the treatment of respiratory and other disorders:
(1) β-agonists including but not limited to: albuterol (PROVENTIL®, SALBUTAMOl®, VENTOLIN®), bambuterol, bitoterol, clenbuterol, fenoterol, formoterol, isoetharine (BRONKOSOL®, BRONKOMETER®), metaproterenol (ALUPENT®, METAPREL®), pirbuterol (MAXAIR®), reproterol, rimiterol, salmeterol, terbutaline (BRETHAIRE®, BRETHINE®, BRICANYL®), adrenalin, isoproterenol (ISUPREL®), epinephrine bitartrate (PRIMATENE®), ephedrine, orciprenline, fenoterol and isoetharine;
(2) steroids, including but not limited to beclomethasone, beclomethasone dipropionate, betamethasone, budesonide, bunedoside, butixocort, dexamethasone, flunisolide, fluocortin, fluticasone, hydrocortisone, methyl prednisone, mometasone, predonisolone, predonisone, tipredane, tixocortal, triamcinolone, and triamcinolone acetonide;

(3) β2-agonist-corticosteroid combinations [e.g., salmeterol-fluticasone (ADVAIR®), formoterol-budesonid (SYMBICORT®)];

(4) leukotriene D4 receptor antagonists/leukotriene antagonists/LTD4 antagonists (i.e., any compound that is capable of blocking, inhibiting, reducing or otherwise interrupting the interaction between leukotrienes and the Cys LTI receptor) including but not limited to: zafirlukast, montelukast, montelukast sodium (SINGULAIR®), pranlukast, iralukast, pobilukast, SKB-106,203 and compounds described as having LTD4 antagonizing activity described in U.S. Pat. No. 5,565,473;

(5) 5-lipoxygenase inhibitors and/or leukotriene biosynthesis inhibitors [e.g., zileuton and BAY1005 (CA registry 128253-31-6)];

(6) histamine H1 receptor antagonists/antihistamines (i.e., any compound that is capable of blocking, inhibiting, reducing or otherwise interrupting the interaction between histamine and its receptor) including but not limited to: astemizole, acrivastine, antazoline, azatadine, azelastine, astamizole, bromopheniramine, bromopheniramine maleate, carbinoxamine, carebastine, cetirizine, chlorpheniramine, chlorpheniramine maleate, cimetidine, clemastine, cyclizine, cyproheptadine, descarboethoxyloratadine, dexchlorpheniramine, dimethindene, diphenhydramine, diphenylpyraline, doxylamine succinate, doxylamine, ebastine, efletirizine, epinastine, farnotidine, fexofenadine, hydroxyzine, hydroxyzine, ketotifen, levocabastine, levocetirizine, levocetirizine, loratadine, meclizine, mepyramine, mequitazine, methdilazine, mianserin, mizolastine, noberastine, norasternizole, noraztemizole, phenindamine, pheniramine, picumast, promethazine, pynlamine, pyrilamine, ranitidine, temelastine, terfenadine, trimeprazine, tripelenamine, and triprolidine;

(7) an anticholinergic including but not limited to: atropine, benztropine, biperiden, flutropium, hyoscyamine, ilutropium, ipratropium, ipratropium bromide, methscopolamine, oxybutinin, rispenzepine, scopolamine, and tiotropium;

(8) an anti-tussive including but not limited to: dextromethorphan, codeine, and hydromorphone;

(9) a decongestant including but not limited to: pseudoephedrine and phenylpropanolamine;

(10) an expectorant including but not limited to: guafenesin, guaicolsulfate, terpin, ammonium chloride, glycerol guaicolate, and iodinated glycerol;

(11) a bronchodilator including but not limited to: theophylline and aminophylline;

(12) an anti-inflammatory including but not limited to: fluribiprofen, diclophenac, indomethacin, ketoprofen, S-ketroprophen, tenoxicam;

(13) a PDE (phosphodiesterase) inhibitor including but not limited to those disclosed herein;

(14) a recombinant humanized monoclonal antibody [e.g. xolair (also called omalizumab), rhuMab, and talizumab];

(15) a humanized lung surfactant including recombinant forms of surfactant proteins SP-B, SP-C or SP-D [e.g. SURFAXIN®, formerly known as dsc-104 (Discovery Laboratories)],

(16) agents that inhibit epithelial sodium channels (ENaC) such as amiloride and related compounds;

(17) antimicrobial agents used to treat pulmonary infections such as acyclovir, amikacin, amoxicillin, doxycycline, trimethoprin sulfamethoxazole, amphotericin B, azithromycin, clarithromycin, roxithromycin, clarithromycin, cephalosporins (cefoxitin, cefmetazole etc), ciprofloxacin, ethambutol, gentimycin, ganciclovir, imipenem, isoniazid, itraconazole, penicillin, ribavirin, rifampin, rifabutin, amantadine, rimantidine, streptomycin, tobramycin, and vancomycin;

(18) agents that activate chloride secretion through Ca++ dependent chloride channels (such as purinergic receptor (P2Y(2) agonists);

(19) agents that decrease sputum viscosity, such as human recombinant DNase 1, (Pulmozyme®);

(20) nonsteroidal anti-inflammatory agents (acemetacin, acetaminophen, acetyl salicylic acid, aldlofenac, alminoprofen, apazone, aspirin, benoxaprofen, bezpiperylon, bucloxic acid, carprofen, clidanac, diclofenac, diclofenac, diflunisal, diflusinal, etodolac, fenbufen, fenbufen, fenclofenac, fenclozic acid, fenoprofen, fentiazac, feprazone, flufenamic acid, flufenisal, flufenisal, fluprofen, flurbiprofen, flurbiprofen, furofenac, ibufenac, ibuprofen, indomethacin, indomethacin, indoprofen, isoxepac, isoxicam, ketoprofen, ketoprofen, ketorolac, meclofenamic acid, meclofenamic acid, mefenamic acid, mefenamic acid, miroprofen, mofebutazone, nabumetone oxaprozin, naproxen, naproxen, niflumic acid, oxaprozin, oxpinac, oxyphenbutazone, phenacetin, phenylbutazone, phenylbutazone, piroxicam, piroxicam, pirprofen, pranoprofen, sudoxicam, tenoxican, sulfasalazine, sulindac, sulindac, suprofen, tiaprofenic acid, tiopinac, tioxaprofen, tolfenamic acid, tolmetin, tolmetin, zidometacin, zomepirac, and zomepirac); and

(21) aerosolized antioxidant therapeutics such as S-Nitrosoglutathione.

The peptides and agonists of the invention can be used in combination therapy with an anti-obesity agent including but not limited to:

(1) 11β HSD-1 (11-beta hydroxy steroid dehydrogenase type 1) inhibitors, such as BVT 3498, BVT 2733, 3-(1-adamantyl)-4-ethyl-5-(ethylthio)-4H-1,2,4-triazole, 3-(1-adamantyl)-5-(3,4,5-trimethoxyphenyl)-4-methyl-4H-1,2,4-triazole, 3-adamantanyl-4,5,6,7,8,9,10,11,12,3a-decahydro-1,2,4-triazolo[4,3-a][11]annulene, and those compounds disclosed in WO01/90091, WO01/90090, WO01/90092 and WO02/072084;

(2) 5HT (serotonin) transporter inhibitors, such as paroxetine, fluoxetine (Prozac®), fenfluramine, fluvoxamine, sertraline, and imipramine, and those disclosed in WO03/00663;

(3) 5HT antagonists such as those in WO03/037871, WO03/037887, and the like;

(4) 5HT1a modulators such as those disclosed in WO03/031439, and the like;

(5) 5HT-2 agonists;

(6) 5HT2c (serotonin receptor 2c) agonists, such as BVT933, DPCA37215, IK264, PNU 22394, WAY161503, R-1065, SB 243213 (Glaxo Smith Kline) and YM 348 and those disclosed in U.S. Pat. No. 3,914,250 and PCT publication Nos. WO02/36596, WO02/48124, WO02/10169, WO01/66548, WO02/44152, WO02/51844, WO02/40456, and WO02/40457;

(7) 5HT6 receptor modulators, such as those in WO03/030901, WO03/035061, WO03/039547, and the like;

(8) ACC2 (acetyl-CoA carboxylase-2) inhibitors;

(9) acyl-estrogens, such as oleoyl-estrone, disclosed in del Mar-Grasa, M. et al., Obesity Research, 9:202-9 (2001) and Japanese Patent Application No. JP 2000256190;

(10) alpha-lipoic acid (alpha-LA);

(11) anorectic bicyclic compounds such as 1426 (Aventis) and 1954 (Aventis), and the compounds disclosed in WO00/18749, WO01/32638, WO01/62746, WO01/62747, and WO03/015769;

(12) AOD9604;

(13) appetite suppressants such as those in WO03/40107;

(14) ATL-962 (Alizyme PLC);

(15) benzocaine;

(16) benzphetamine hydrochloride (Didrex);
(17) bladderwrack (focus vesiculosus);
(18) BRS3 (bombesin receptor subtype 3) agonists;
(19) bupropion;
(20) caffeine;
(21) CB 1 (cannabinoid-1 receptor) antagonist/inverse agonists, such as rimonabant (Acomplia; Sanofi Synthelabo), SR-147778 (Sanofi Synthelabo), BAY 65-2520 (Bayer), and SLV 319 (Solvay), and those disclosed in U.S. Pat. Nos. 4,973,587, 5,013,837, 5,081,122, 5,112,820, 5,292,736, 5,532,237, 5,624,941, 6,028,084, and 6,509,367 and WO96/33159, WO97/29079, WO98/31227, WO98/33765, WO98/37061, WO98/41519, WO98/43635, WO98/43636, WO99/02499, WO00/10967, WO00/10968, WO01/09120, WO01/58869, WO01/64632, WO01/64633, WO01/64634, WO01/70700, WO01/96330, WO02/076949, WO03/006007, WO03/007887, WO03/020217, WO03/026647, WO03/026648, WO03/027069, WO03/027076, WO03/027114, WO03/037332, WO03/040107, WO03/086940, WO03/084943 and U.S. Pat. No. 6,509,367 and EPO Application No. EP-658546;
(22) CCK agonists;
(23) CCK-A (cholecystokinin-A) agonists, such as AR-R 15849, GI 181771, JMV-180, A-71378, A-71623 and SR146131, and those described in U.S. Pat. No. 5,739,106;
(24) chitosan;
(25) chromium;
(26) CNTF (Ciliary neurotrophic factors), such as GI-181771 (Glaxo-SmithKline), SR146131 (Sanofi Synthelabo), butabindide, PD170,292, and PD 149164 (Pfizer);
(27) CNTF derivatives, such as axokine (Regeneron), and those disclosed in PCT Application Nos. WO 94/09134, WO 98/22128, and WO 99/43813;
(28) conjugated linoleic acid;
(29) corticotropin-releasing hormone agonists;
(30) dehydroepiandrosterone;
(31) DGAT1 (diacylglycerol acyltransferase 1) inhibitors;
(32) DGAT2 (diacylglycerol acyltransferase 2) inhibitors;
(33) dicarboxylate transporter inhibitors;
(34) diethylpropion hydrochloride (Tenuate);
(35) dipeptidyl peptidase IV (DP-IV) inhibitors, such as isoleucine thiazolidide, valine pyrrolidide, NVP-DPP728, LAF237, P93/01, TSL 225, TMC-2A/2B/2C, FE 999011, P9310/K364, VIP 0177, SDZ 274-444 and the compounds disclosed in PCT publication Nos. WO02/083128, WO02/062764, WO03/000180, WO03/000181, WO03/000250, WO03/002530, WO03/002531, WO03/002553, WO03/002593, WO03/004498, WO03/004496, WO03/017936, WO03/024942, WO03/024965, WO03/033524, WO03/037327 and EP1258476;
(36) ephedra;
(37) exendin-4 (an inhibitor of glp-1)
(38) FAS (fatty acid synthase) inhibitors, such as Cerulenin and C75;
(39) fat resorption inhibitors such as those in WO03/053451, and the like;
(40) fatty acid transporter inhibitors;
(41) fiber (psyllium, plantago, guar fiber);
(42) galanin antagonists;
(43) galega (Goat's Rue, French Lilac);
(44) garcinia cambogia;
(45) germander (teucrium chamaedrys);
(46) ghrelin antagonists, such as those disclosed in PCT Application Nos. WO 01/87335, and WO 02/08250;
(47) GLP-1 (glucagon-like peptide 1) agonists (e.g. exendin-4);
(48) glp-1 (glucagon-like peptide-1);
(49) glucocorticoid antagonists;
(50) glucose transporter inhibitors;
(51) growth hormone secretagogue receptor agonists/antagonists, such as NN703, hexarelin, MK-0677, SM-130686, CP-424,391, L-692,429 and L-163,255, and such as those disclosed in U.S. Pat. No. 6,358,951, U.S. Patent Application Nos. 2002/049196 and 2002/022637, and PCT Application Nos. WO 01/56592 and WO 02/32888;
(52) growth hormone secretagogues, such as those disclosed and specifically described in U.S. Pat. No. 5,536,716;
(53) H3 (histamine H3) antagonist/inverse agonists, such as thioperamide, 3-(1H-imidazol-4-yl)propyl N-(4-pentenyl) carbamate), clobenpropit, iodophenpropit, imoproxifan, GT2394 (Gliatech), and A331440, and those disclosed in PCT publication No. WO02/15905 and O-[3-(1H-imidazol-4-yl)propanol]carbamates (Kiec-Kononowicz, K. et al., Pharmazie, 55:349-55 (2000)), piperidine-containing histamine H3-receptor antagonists (Lazewska, D. et al., Pharmazie, 56:927-32 (2001), benzophenone derivatives and related compounds (Sasse, A. et al., Arch. Pharm. (Weinheim) 334:45-52 (2001)), substituted N-phenylcarbamates (Reidemeister, S. et al., Pharmazie, 55:83-6 (2000)), and proxifan derivatives (Sasse, A. et al., J. Med. Chem. 43:3335-43 (2000)) and histamine H3 receptor modulators such as those disclosed in WO03/024928 and WO03/024929;
(54) interleukin-6 (IL-6) and modulators thereof, as in WO03/057237, and the like;
(55) L-carnitine;
(56) leptin derivatives, such as those disclosed in U.S. Pat. Nos. 5,552,524, 5,552,523, 5,552,522, 5,521,283, and PCT International Publication Nos. WO 96/23513, WO 96/23514, WO 96/23515, WO 96/23516, WO 96/23517, WO 96/23518, WO 96/23519, and WO 96/23520;
(57) leptin, including recombinant human leptin (PEG-OB, Hoffman La Roche) and recombinant methionyl human leptin (Amgen);
(58) lipase inhibitors, such as tetrahydrolipstatin (orlistat/Xenical®), Triton WR1339, RHC80267, lipstatin, teasaponin, and diethylumbelliferyl phosphate, FL-386, WAY-121898, Bay-N-3176, valilactone, esteracin, ebelactone A, ebelactone B, and RHC 80267, and those disclosed in PCT publication No. WO01/77094, and U.S. Pat. Nos. 4,598,089, 4,452,813, 5,512,565, 5,391,571, 5,602,151, 4,405,644, 4,189,438, and 4,242,453;
(59) lpid metabolism modulators such as maslinic acid, erythrodiol, ursolic acid uvaol, betulinic acid, betulin, and the like and compounds disclosed in WO03/011267;
(60) Mc3r (melanocortin 3 receptor) agonists;
(61) Mc4r (melanocortin 4 receptor) agonists, such as CHIR86036 (Chiron), ME-10142, ME-10145, and HS-131 (Melacure), and those disclosed in PCT publication Nos. WO99/64002, WO00/74679, WO01/991752, WO01/25192, WO01/52880, WO01/74844, WO01/70708, WO01/70337, WO01/91752, WO02/059095, WO02/059107, WO02/059108, WO02/059117, WO02/06276, WO02/12166, WO02/11715, WO02/12178, WO02/15909, WO02/38544, WO02/068387, WO02/068388, WO02/067869, WO02/081430, WO03/06604, WO03/007949, WO03/009847, WO03/009850, WO03/013509, and WO03/031410;
(62) Mc5r (melanocortin 5 receptor) modulators, such as those disclosed in WO97/19952, WO00/15826, WO00/15790, US 20030092041;
(63) MCH2R (melanin concentrating hormone 2R) agonist/antagonists;
(64) melanin concentrating hormone antagonists;
(65) melanin-concentrating hormone 1 receptor (MCHR) antagonists, such as T-226296 (Takeda), SNP-7941 (Synaptic), and those disclosed WO01/21169, WO01/82925, WO01/87834, WO02/051809, WO02/06245, WO02/076929, WO02/076947, WO02/04433, WO02/51809, WO02/083134, WO02/094799, WO03/004027, WO03/13574, WO03/15769, WO03/028641, WO03/035624, WO03/033476, WO03/033480 and Japanese Patent Application Nos. JP 13226269, and JP1437059;

(66) melanocortin agonists, such as Melanotan II or those described in WO 99/64002 and WO 00/74679;

(67) Metformin (GLUCOPHAGE®);

(68) mGluR5 modulators such as those disclosed in WO03/029210, WO03/047581, WO03/048137, WO03/051315, WO03/051833, WO03/053922, WO03/059904, and the like;

(69) monoamine reuptake inhibitors, such as sibutratmine (Meridia®/Reductil®) and salts thereof, and those compounds disclosed in U.S. Pat. Nos. 4,746,680, 4,806,570, and 5,436,272, and U.S. Patent Publication No. 2002/0006964, and WO01/27068, and WO01/62341;

(70) NE (norepinephrine) transport inhibitors, such as GW 320659, despiramine, talsupram, and nomifensine;

(71) nomame herba;

(72) non-selective serotonin/norepinephrine transport inhibitors, such as sibutramine or fenfluramine;

(73) NPY 1 antagonists, such as BIBP3226, J-115814, BIBO 3304, LY-357897, CP-671906, GI-264879A, and those disclosed in U.S. Pat. No. 6,001,836, and PCT Patent Publication Nos. WO 96/14307, WO 01/23387, WO 99/51600, WO 01/85690, WO 01/85098, WO 01/85173, and WO 01/89528;

(74) NPY5 (neuropeptide Y Y5) antagonists, such as 152,804, GW-569180A, GW-594884A, GW-587081X, GW-548118X, FR235208, FR226928, FR240662, FR252384, 1229U91, GI-264879A, CGP71683A, LY-377897, LY-366377, PD-160170, SR-120562A, SR-120819A, JCF-104, and H409/22 and those compounds disclosed in U.S. Pat. Nos. 6,140,354, 6,191,160, 6,258,837, 6,313,298, 6,326,375, 6,329,395, 6,335,345, 6,337,332, 6,329,395, and 6,340,683, European Patent Nos. EP-01010691, and EP-01044970 and PCT Publication Nos. WO97/19682, WO97/20820, WO97/20821, WO97/20822, WO97/20823, WO98/27063, WO00/107409, WO00/185714, WO00/185730, WO00/64880, WO00/68197, WO00/69849, WO01/09120, WO01/14376, WO01/85714, WO01/85730, WO01/07409, WO01/02379, WO01/23388, WO01/23389, WO01/44201, WO01/62737, WO01/62738, WO01/09120, WO02/20488, WO02/22592, WO02/48152, WO02/49648, WO02/051806, WO02/094789, WO03/009845, WO03/014083, WO03/022849, WO03/028726 and Norman et al., J. Med. Chem. 43:4288-4312 (2000);

(75) opioid antagonists, such as nalmefene (REVEX®), 3-methoxynaltrexone, naloxone, and naltrexone and those disclosed in WO00/21509;

(76) orexin antagonists, such as SB-334867-A and those disclosed in PCT publication Nos. WO01/96302, WO01/68609, WO02/44172, WO02/51232, WO02/51838, WO02/089800, WO02/090355, WO03/023561, WO03/032991, and WO03/037847;

(77) PDE (phosphodiesterase) inhibitors including but not limited to those disclosed herein;

(78) peptide YY and fragments and variants thereof (e.g. YY3-36 (PYY3-36) (N. Engl. J. Med. 349:941, 2003; IKPEAPGE DASPEELNRY YASLRHYLNL VTRQRY (SEQ ID NO:XXX)) and PYY agonists such as those disclosed in WO03/026591;

(79) phendimetrazine;

(80) phentermine,

(81) phosphate transporter inhibitors;

(82) phosphodiesterase-3B (PDE3B) inhibitors;

(83) phytopharm compound 57 (CP 644,673);

(84) pyruvate;

(85) SCD-1 (stearoyl-CoA desaturase-1) inhibitors;

(86) serotonin reuptake inhibitors, such as dexfenfluramine, fluoxetine, and those in U.S. Pat. No. 6,365,633, and WO01/27060, and WO01/162341;

(87) T71 (Tularik; Inc.; Boulder Colo.);

(88) thyroid hormone β agonists, such as KB-2611 (KaroBioBMS), and those disclosed in WO02/15845 and Japanese Patent Application No. JP 2000256190;

(89) Topiramate (TOPIMAX®);

(90) transcription factor modulators such as those disclosed in WO03/026576;

(91) UCP-1 (uncoupling protein-1), 2, or 3 activators, such as phytanic acid, 4-[(E)-2-(5,6,7,8-tetrahydro-5,5,8,8-tetramethyl-2-napthalenyl)-1-propeny-1]benzoic acid (TT-NPB), retinoic acid, and those disclosed in PCT Patent Application No. WO 99/00123;

(92) β3 (beta adrenergic receptor 3) agonists, such as AD9677/TAK677 (Dainippon/Takeda), CL-316,243, SB 418790, BRL-37344, L-796568, BMS-196085, BRL-35135A, CGP12177A, BTA-243, GW 427353, Trecadrine, Zeneca D7114, N-5984 (Nisshin Kyorin), LY-377604 (Lilly), and SR 59119A, and those disclosed in U.S. Pat. No. 5,705,515, U.S. Pat. No. 5,451,677 and PCT publication Nos. WO94/18161, WO95/29159, WO97/46556, WO98/04526 and WO98/32753, WO01/74782, WO02/32897, WO03/014113, WO03/016276, WO03/016307, WO03/024948, WO03/024953 and WO03/0378811;

(93) β-hydroxy steroid dehydrogenase-1 inhibitors (β-HSD-1) and

(94) β-hydroxy-β-methylbutyrate.

Peptides and agonists of the invention useful in the treatment of obesity can be administered as a cotherapy with electrostimulation (US20040015201).

The peptides and agonists of the invention can be used in combination therapy with agents that activate soluble guanylate cyclase, for example those described in US20040192680.

The peptides and agonists of the invention can be used in combination therapy with a phosphodiesterase inhibitor. PDE inhibitors within the meaning of the present invention are those compounds which slow the degradation of cyclic AMP (cAMP) and/or cyclic GMP (cGMP) by inhibition of the phosphodiesterases, which can lead to a relative increase in the intracellular concentration of cAMP and cGMP. Possible PDE inhibitors within the meaning of the present invention are primarily those substances which are to be numbered among the class consisting of the PDE3 inhibitors, the class consisting of the PDE4 inhibitors and/or the class consisting of the PDE5 inhibitors, in particular those substances which can be designated as mixed types of PDE3/4 inhibitors or as mixed types of PDE3/4/5 inhibitors. By way of example, those PDE inhibitors may be mentioned such as are described and/or claimed in the following patent applications and patents: DE1470341, DE2108438, DE2123328, DE2305339, DE2305575, DE2315801, DE2402908, DE2413935, DE2451417, DE2459090, DE2646469, DE2727481, DE2825048, DE2837161, DE2845220, DE2847621, DE2934747, DE3021792, DE3038166, DE3044568, EP000718, EP0008408, EP0010759, EP0059948, EP0075436, EP0096517, EP0112987, EP0116948, EP0150937, EP0158380, EP0161632, EP0161918, EP0167121, EP0199127, EP0220044, EP0247725, EP0258191, EP0272910, EP0272914, EP0294647, EP0300726, EP0335386, EP0357788, EP0389282, EP0406958, EP0426180, EP0428302, EP0435811, EP0470805, EP0482208, EP0490823, EP0506194, EP0511865, EP0527117, EP0626939, EP0664289, EP0671389, EP0685474, EP0685475, EP0685479, JP92234389, JP94329652, JP95010875, U.S. Pat. Nos. 4,963,561, 5,141,931, WO9117991, WO9200968, WO9212961, WO9307146, WO9315044, WO9315045, WO9318024, WO9319068, WO9319720, WO9319747, WO9319749, WO9319751, WO9325517, WO9402465, WO9406423, WO9412461, WO9420455, WO9422852, WO9425437, WO9427947, WO9500516, WO9501980, WO9503794, WO9504045, WO9504046, WO9505386, WO9508534, WO9509623, WO9509624, WO9509627, WO9509836, WO9514667, WO9514680, WO9514681, WO9517392, WO9517399, WO9519362, WO9522520, WO9524381, WO9527692, WO9528926, WO9535281, WO9535282, WO9600218, WO9601825, WO9602541, WO9611917, DE3142982, DE1116676, DE2162096, EP0293063, EP0463756, EP0482208, EP0579496, EP0667345 U.S. Pat. No. 6,331,543, US20050004222 (including those disclosed in formulas I-XIII and paragraphs 37-39, 85-0545 and 557-577) and WO9307124, EP0163965, EP0393500, EP0510562, EP0553174, WO9501338 and WO9603399. PDE5 inhibitors which may be mentioned by way of example are RX-RA-69, SCH-51866, KT-734, vesnarinone, zaprinast, SKF-96231, ER-21355, BF/GP-385, NM-702 and sildenafil (Viagra®). PDE4 inhibitors which may be mentioned by way of example are RO-20-1724, MEM 1414 (R1533/R1500; Pharmacia Roche), DENBUFYL-LINE, ROLIPRAM, OXAGRELATE, NITRAQUAZONE, Y-590, DH-6471, SKF-94120, MOTAPIZONE, LIXAZI-NONE, INDOLIDAN, OLPRINONE, ATIZORAM, KS-506-G, DIPAMFYLLINE, BMY-43351, ATIZORAM, AROFYLLINE, FILAMINAST, PDB-093, UCB-29646, CDP-840, SKF-107806, PICLAMILAST, RS-17597, RS-25344-000, SB-207499, TIBENELAST, SB-210667, SB-211572, SB-211600, SB-212066, SB-212179, GW-3600, CDP-840, MOPIDAMOL, ANAGRELIDE, IBUDILAST, AMRINONE, PIMOBENDAN, CILOSTA-ZOL, QUAZINONE and N-(3,5-dichloropyrid-4-yl)-3-cyclopropylmethoxy-4-difluoromethoxybenzamide. PDE3 inhibitors which may be mentioned by way of example are SULMAZOLE, AMPIZONE, CILOSTAMIDE, CARBAZ-ERAN, PIROXIMONE, IMAZODAN, CI-930, SIGUA-ZODAN, ADIBENDAN, SATERINONE, SKF-95654, SDZ-MKS-492, 349-U-85, EMORADAN, EMD-53998, EMD-57033, NSP-306, NSP-307, REVIZINONE, NM-702, WIN-62582 and WIN-63291, ENOXIMONE and MILRINONE. PDE3/4 inhibitors which may be mentioned by way of example are BENAFENTRINE, TREQUINSIN, ORG-30029, ZARDAVERINE, L-686398, SDZ-ISQ-844, ORG-20241, EMD-54622, and TOLAFENTRINE. Other PDE inhibitors include: cilomilast, pentoxifylline, roflumilast, tadalafil (Clalis®), theophylline, and vardenafil (Levitra®), zaprinast (PDE5 specific).

Methods of Treatment

A number of disorders might be treated with GC-C receptor agonists and agents that increase cGMP levels including the peptides and agonists of the invention.

The peptides and agonists of the invention can be used alone or in combination therapy for the treatment or prevention of congestive heart failure. Such agents can be used in combination with natriuretic peptides (e.g., atrial natriuretic peptide, brain natriuretic peptide or C-type natriuretic peptide), a diuretic, or an inhibitor of angiotensin converting enzyme.

The peptides and agonists of the invention can be used alone or in combination therapy for the treatment or prevention of benign prostatic hyperplasia (BPH). Such agents can be used in combination with one or more agents for treatment of BPH, for example, a 5-alpha reductase inhibitor (e.g., finasteride) or an alpha adrenergic inhibitor (e.g., doxazosine).

The peptides and agonists of the invention can be used alone or in combination therapy for the treatment, prevention or reduction of visceral pain associated with a gastrointestinal disorder or pain associated with another disorder.

The peptides and agonists of the invention can be used alone or in combination therapy for the treatment or prevention of obesity-related disorders (e.g. disorders that are associated with, caused by, or result from obesity). Examples of obesity-related disorders include overeating and bulimia, hypertension, diabetes, elevated plasma insulin concentrations and insulin resistance, dyslipidemias, hyperlipidemia, endometrial, breast, prostate and colon cancer, osteoarthritis, obstructive sleep apnea, cholelithiasis, gallstones, heart disease, abnormal heart rhythms and arrhythmias, myocardial infarction, congestive heart failure, coronary heart disease, sudden death, stroke, polycystic ovarian disease, craniopharyngioma, the Prader-Willi Syndrome, Frohlich's syndrome, GH-deficient subjects, normal variant short stature, Turner's syndrome, and other pathological conditions showing reduced metabolic activity or a decrease in resting energy expenditure as a percentage of total fat-free mass, e.g., children with acute lymphoblastic leukemia. The agents of the invention may be used to reduce or control body weight (or fat) or to prevent and/or treat obesity or other appetite related disorders related to the excess consumption of food, ethanol and other appetizing substances. The agents may be used to modulate lipid metabolism, reduce body fat (e.g. via increasing fat utilization) or reduce (or suppress) appetite (e.g. via inducing satiety). Further examples of obesity-related disorders are metabolic syndrome, also known as syndrome X, insulin resistance syndrome, sexual and reproductive dysfunction, such as infertility, hypogonadism in males and hirsutism in females, gastrointestinal motility disorders, such as obesity-related gastroesophageal reflux, respiratory disorders, such as obesity-hypoventilation syndrome (Pickwickian syndrome), cardiovascular disorders, inflammation, such as systemic inflammation of the vasculature, arteriosclerosis, hypercholesterolemia, hyperuricaemia, lower back pain, gallbladder disease, gout, and kidney cancer. The agents of the present invention are also useful for reducing the risk of secondary outcomes of obesity, such as reducing the risk of left ventricular hypertrophy.

The peptides and agonists of the invention can be used alone or in combination therapy for the treatment or prevention of gastrointestinal related disorders including: chronic intestinal pseudo-obstruction (Ogilvie's syndrome), colonic pseudoobstruction, Crohn's disease, dyspepsia (including functional dyspepsia or nonulcer dyspepsia), duodenogastric reflux, functional bowel disorder, functional gastrointestinal disorders, functional heartburn, gastroesophageal reflux disease (GERD), gastrointestinal motility disorders, gastroparesis (e.g. idopathic gastroparesis), hypertrophic pyloric stenosis, Inflammatory bowel disease, irritable bowel syndrome (IBS), post-operative ileus, and ulcerative colitis. The peptides and agonists of the invention can be used alone or in combination therapy to patient suffering from or susceptible to GI disorders relating to damage to the GI tract stemming from impact or surgical intervention. The peptides and agonists of the invention can be used alone or in combination therapy to patients at risk for or having particular diseases associated with hypomotility or stasis in the GI tract. For example, diabetic neuropathy, anorexia nervosa, and achlorhydria are frequently accompanied by gastric hypomotility. Damage to the GI tract following surgical intervention, for instance, can result in substantial gastric stasis. The peptides and agonists of the invention can be administered alone or in combination therapy to patients susceptible to or having a GI disorder associated with diabetes (e.g. diabetic gastropathy). The peptides and agonists of the invention can be used alone or in combination therapy to prevent and/or treat GI disorders characterized by at least one of nausea, vomiting, heartburn, postprandial discomfort, diarrhea, constipation, indigestion or related symptoms. The peptides and agonists of the invention can be used alone or in combination therapy to prevent and/or treat GI disorders associated with at least one of diabetes, anorexia nervosa, bulimia, achlorhydria, achalasia, anal fissure, irritable bowel syndrome, intestinal pseudoobstruction, scleroderma and gastrointestinal damage.

The peptides and agonists of the invention can be used to prevent and/or treat constipation (e.g. constipation associated with use of a therapeutic agent; constipation associated with a neuropathic, metabolic or endocrine disorder (including autonomic neuropathy, Chagas disease, cystic fibrosis, diabetes mellitus, Hirschsprung disease, hyperthyroidism, hypocalcaemia, hypothyroidism, Multiple Sclerosis, neurofibromatosis, Parkinson's disease, and spinal cord lesions); post-surgical constipation (postoperative ileus); constipation associated with a gastrointestinal disorder; idiopathic constipation (functional constipation or slow transit constipation); constipation associated with the use of analgesic drugs (e.g. opioid induced constipation); constipation associated with the use of other agents (e.g. antihypertensives, anticonvulsants, antidepressants, antispasmodics and antipsychotics); megacolon; and chronic constipation).

The peptides and agonists of the invention can be used to treat decreased intestinal motility, slow digestion or slow stomach emptying. The peptides and agonists can be used to relieve one or more symptoms of IBS (bloating, pain, constipation), GERD (acid reflux into the esophagus), duodenogastric reflux, functional dyspepsia, or gastroparesis (nausea, vomiting, bloating, delayed gastric emptying) and other disorders described herein.

The peptides and agonists of the invention can be used to increase intestinal motility and to prevent and/or treat gastrointestinal immotility and other conditions calling for laxative or stool softener therapy. Gastrointestinal immotility can include constipation, and also includes delayed oral cecal transit time, irregular Taxation, and other related gastrointestinal motility disfunction including impaction. Impaction is a condition where a large mass of dry, hard stool develops in the rectum, often due to chronic constipation. This mass may be so hard that it cannot be excreted. The subjects affected by constipation or gastrointestinal immotility can be refractory to laxative therapy and/or stool softener therapy.

The peptides and agonists of the invention can be used for the treatment or prevention of cancer, pre-cancerous growths, or metastatic growths. For example, they can be used for the prevention or treatment of: colorectal/local metastasized colorectal cancer, intestinal polyps, gastrointestinal tract cancer, lung cancer, cancer or pre-cancerous growths or metastatic growths of epithelial cells, polyps, breast, colorectal, lung, ovarian, pancreatic, prostatic, renal, stomach, bladder, liver, esophageal and testicular carcinoma, carcinoma (e.g., basal cell, basosquamous, Brown-Pearce, ductal carcinoma, Ehrlich tumor, Krebs, Merkel cell, small or non-small cell lung, oat cell, papillary, bronchiolar, squamous cell, transitional cell, (Walker), leukemia (e.g., B-cell, T-cell, HTLV, acute or chronic lymphocytic, mast cell, myeloid), histiocytonia, histiocytosis, Hodgkin's disease, non-Hodgkin's lymphoma, plasmacytoma, reticuloendotheliosis, adenoma, adeno-carcinoma, adenofibroma, adenolymphoma, ameloblastoma, angiokeratoma, angiolymphoid hyperplasia with eosinophilia, sclerosing angioma, angiomatosis, apudoma, branchionia, malignant carcinoid syndrome, carcinoid heart disease, carcinosarcoma, cementoma, cholangioma, cholesteatoma, chondrosarcoma, chondroblastoma, chondrosarcoma, chordoma, choristoma, craniopharyngioma, chrondrorna, cylindroma, cystadenocarcinoma, cystadenoma, cystosarconia phyllodes, dysgenninoma, ependymoma, Ewing sarcoma, fibroma, fibrosarcoma, giant cell tumor, ganglioneuroma, glioblastoma, glomangioma, granulosa cell tumor, gynandroblastoma, hamartoma, hemangioendothelioma, hemangioma, hemangiopericytoma, hemangiosarcoma, hepatoma, islet cell tumor, Kaposi sarcoma, leiomyoma, leiomyosarcoma, leukosarcoma, Leydig cell tumor, lipoma, liposarcoma, lymphaugioma, lymphangiomyoma, lymphangiosarcoma, medulloblastoma, meningioma, mesenchymoma, mesonephroma, mesothelioma, myoblastoma, myoma, myosarcoma, myxoma, myxosarcoma, neurilemmoma, neuroma, neuroblastoma, neuroepithelioma, neurofibroma, neurofibromatosis, odontoma, osteoma, osteosarcoma, papilloma, paraganglioma, paraganglionia. nonchroinaffin, pinealoma, rhabdomyoma, rhabdomyosarcoma, Sertoli cell tumor, teratoma, theca cell tumor, and other diseases in which cells have become dysplastic, immortalized, or transformed.

The peptides and agonists of the invention can be used for the treatment or prevention of: Familial Adenomatous Polyposis (FAP) (autosomal dominant syndrome) that precedes colon cancer, hereditary nonpolyposis colorectal cancer (HNPCC), and inherited autosomal dominant syndrome.

For treatment or prevention of cancer, pre-cancerous growths and metastatic growths, the peptides and agonists of the invention can be used in combination therapy with radiation or chemotherapeutic agents, an inhibitor of a cGMP-dependent phosphodiesterase or a selective cyclooxygenase-2 inhibitor. A number of selective cyclooxygenase-2 inhibitors are described in US20010024664, U.S. Pat. No. 5,380,738, U.S. Pat. No. 5,344,991, U.S. Pat. No. 5,393,790, U.S. Pat. No. 5,434,178, U.S. Pat. No. 5,474,995, U.S. Pat. No. 5,510,368, WO02/062369, WO 96/06840, WO 96/03388, WO 96/03387, WO 96/19469, WO 96/25405, WO 95/15316, WO 94/15932, WO 94/27980, WO 95/00501, WO 94/13635, WO 94/20480, and WO 94/26731, the disclosures of which are herein incorporated by reference. [Pyrazol-1-yl] benzenesulfonamides have also been described as inhibitors of cyclooxygenase-2. The peptides and agonists of the invention can be used in the treatment or prevention of inflammation. Thus, they can be used alone or in combination with an inhibitor of cGMP-dependent phosphodiesterase or a selective cyclooxygenase-2 inhibitor for treatment of: organ inflammation, IBD (e.g, Crohn's disease, ulcerative colitis), asthma, nephritis, hepatitis, pancreatitis, bronchitis, cystic fibrosis, ischemic bowel diseases, intestinal inflammations/ allergies, coeliac disease, proctitis, eosnophilic gastroenteritis, mastocytosis, and other inflammatory disorders. The peptides and agonists of the invention can be used alone or in combination therapy in the treatment or prevention of gastrointestinal tract inflammation (e.g. inflammation associated with a gastrointestinal disorder, gastrointestinal tract infection, or another disorder).

The peptides and agonists of the invention can also be used to treat or prevent insulin-related disorders, for example: II diabetes mellitus, hyperglycemia, obesity, disorders associated with disturbances in glucose or electrolyte transport and insulin secretion in cells, or endocrine disorders. They can be also used in insulin resistance treatment and post-surgical and non-post surgery decrease in insulin responsiveness.

The peptides and agonists of the invention can be used to prevent and/or treat pulmonary and respiratory related disorders, including, inhalation, ventilation and mucus secretion disorders, pulmonary hypertension, chronic obstruction of vessels and airways, and irreversible obstructions of vessels and bronchi. One may administer an agent of the invention for treating bronchospasm, for inducing bronchodilation, for treating chronic obstructive pulmonary disease (including chronic bronchitis with normal airflow), for treating asthma (including bronchial asthma, intrinsic asthma, extrinsic asthma, chronic or inveterate asthma (e.g. late asthma and airways hyper-responsiveness), dust-induced asthma, allergen-induced asthma, viral-induced asthma, cold-induced asthma, pollution-induced asthma and exercise-induced asthma) and for treating rhinitis (including acute-, allergic, hatrophic rhinitis or chronic rhinitis (such as rhinitis caseosa, hypertrophic rhinitis, rhinitis purulenta, rhinitis sicca), rhinitis medicamentosa, membranous rhinitis (including croupous, fibrinous and pseudomembranous rhinitis), scrofulous rhinitis, perennial allergic rhinitis, seasonal rhinitis (including rhinitis nervosa (hay fever) and vasomotor rhinitis). The peptides of the invention may also be useful in the treatment of dry eye disease and chronic sinusitis. The peptides of the invention may also be used to prevent and/or treat disorders characterized by acute pulmonary vasoconstriction such as may result from pneumonia, traumatic injury, aspiration or inhalation injury, fat embolism in the lung, acidosis inflammation of the lung, adult respiratory distress syndrome, acute pulmonary edema, acute mountain sickness, post-cardiac surgery, acute pulmonary hypertension, persistent pulmonary hypertension of the newborn, perinatal aspiration syndrome, hyaline membrane disease, acute pulmonary thromboembolism, herapin-protamine reactions, sepsis, status asthmaticus or hypoxia (including iatrogenic hypoxia) and other forms of reversible pulmonary vasoconstriction. Such pulmonary disorders also are also characterized by inflammation of the lung including those associated with the migration into the lung of nonresident cell types including the various leucocyte subclasses. Also included in the respiratory disorders contemplated are: bullous disease, cough, chronic cough associated with inflammation or iatrogenic induced, airway constriction, pigeon fancier's disease, eosinophilic bronchitis, asthmatic bronchitis, chronic bronchitis with airway obstruction (chronic obstructive bronchitis), eosinophilic lung disease, emphysema, farmer's lung, allergic eye diseases (including allergic conjunctivitis, vernal conjunctivitis, vernal keratoconjunctivitis, and giant papillary conjunctivitis), idiopathic pulmonary fibrosis, cystic fibrosis, diffuse pan bronchiolitis and other diseases which are characterized by inflammation of the lung and/or excess mucosal secretion. Other physiological events which are contemplated to be prevented, treated or controlled include platelet activation in the lung, chronic inflammatory diseases of the lung which result in interstitial fibrosis, such as interstitial lung diseases (ILD) (e.g., idiopathic pulmonary fibrosis, or ILD associated with rheumatoid arthritis, or other autoimmune conditions), chronic obstructive pulmonary disease (COPD) (such as irreversible COPD), chronic sinusitis, fibroid lung, hypersensitivity lung diseases, hypersensitivity pneumonitis, idiopathic interstitial pneumonia, nasal congestion, nasal polyposis, and otitis media.

The peptides and agonists of the invention can be used alone or in combitherapy to prevent or treat: retinopathy, nephropathy, diabetic angiopathy, and edema formation The peptides and agonists of the invention can be used alone or in combitherapy to prevent or treat neurological disorders, for example, headache, migraines, anxiety, stress, cognitive disorders, cerebral ischemia, brain trauma, movement disorders, aggression, psychosis, seizures, panic attacks, hysteria, sleep disorders, depression, schizoaffective disorders, sleep apnea, attention deficit syndromes, memory loss, dementia, memory and learning disorders as discussed in Moncada and Higgs 1995 FASEB J. 9:1319-1330; Severina 1998 Biochemistry 63:794; Lee et al. 2000 PNAS 97: 10763-10768; Hobbs 1997 TIPS 18:484-491; Murad 1994 Adv. Pharmacol. 26:1-335; and Denninger et al. 1999 Biochim. Biophys. Acta 1411:334-350 and narcolepsy. They may also be used as a sedative.

The peptides and detectably peptides and agonists of the invention can be used as markers to identify, detect, stage, or diagnosis diseases and conditions of small intestine, including, without limitation: Crohn's disease, colitis, inflammatory bowel disease, tumors, benign tumors, such as benign stromal tumors, adenoma, angioma, adenomatous (pedunculated and sessile) polyps, malignant, carcinoid tumors, endocrine cell tumors, lymphoma, adenocarcinoma, foregut, midgut, and hindgut carcinoma, gastroinstestinal stromal tumor (GIST), such as leiomyoma, cellular leiomyoma, leiomyoblastoma, and leiomyosarcoma, gastrointestinal autonomic nerve tumor, malabsorption syndromes, celiac diseases, diverticulosis, Meckel's diverticulum, colonic diverticula, megacolon, Hirschsprung's disease, irritable bowel syndrome, mesenteric ischemia, ischemic colitis, colorectal cancer, colonic polyposis, polyp syndrome, intestinal adenocarcinoma, Liddle syndrome, Brody myopathy, infantile convulsions, and choreoathetosis The peptides and agonists of the invention can be conjugated to another molecule (e.g., a diagnostic or therapeutic molecule) to target cells bearing the GC-C receptor, e.g., cystic fibrosis lesions and specific cells lining the intestinal tract. Thus, they can be used to target radioactive moieties or therapeutic moieties to the intestine to aid in imaging and diagnosing or treating colorectal/metastasized or local colorectal cancer and to deliver normal copies of the p53 tumor suppressor gene to the intestinal tract. The peptides and agonists of the invention can also be used to increase the number of GC-C molecules on the surface of a cell. In some embodiments the cell is a metastasized colorectal cancer cell. In one embodiment the peptide or agonist of the invention is therapeutically conjugated to a second agent. In certain embodiments, the second agent can be radioactive or radiostable. In certain embodiments the second agent can be selected from the group consisting of a compound that causes cell death, a compound that inhibits cell division, a compound that induces cell differentiation, a chemotherapeutic, a toxin and a radiosensitizing agent. In certain embodiments the second agent can be selected from the group consisting of: methotrexate, doxorubicin, daunorubicin, cytosinarabinoside, etoposide, 5-4 fluorouracil, melphalan, chlorambucil, cis-platin, vindesine, mitomycin, bleomycin, purothionin, macromomycin, 1,4-benzoquinone derivatives, trenimon, ricin, ricin A chain, *Pseudomonas* exotoxin, diphtheria toxin, *Clostridium perfringens* phospholipase C, bovine pancreatic ribonuclease, pokeweed antiviral protein, abrin, abrin A chain, cobra venom factor, gelonin, saporin, modeccin, viscumin, volkensin, nitroimidazole, metronidazole and misonidazole.

The peptides and agonists of the invention can be used alone or in combination therapy to prevent and/or treat inner ear disorders, e.g., to prevent and/or treat Meniere's disease (including symptoms thereof such as vertigo, hearing loss, tinnitus, sensation of fullness in the ear), Mal de debarquement syndrome, otitis externa, otitis media, otorrhea, acute mastoiditis, otosclerosis, otic pain, otic bleeding, otic inflammation, Lermoyez's syndrome, vestibular neuronitis, benign paroxysmal positional vertigo (BPPV), herpes zoster oticus, Ramsay Hunt's syndrome, herpes, labyrinthitis, purulent labyrinthitis, perilymph fistulas, presbycusis, ototoxicity (including drug-induced ototoxicity), neuromias (including acoustic neuromas), aerotitis media, infectious myringitis, bullous myringitis, squamous cell carcinoma, basal cell carcinoma, pre-cancerous otic conditions, nonchromaffin paragangliomas, chemodectomas, glomus jugulare tumors, glomus tympanicum tumors, perichondritis, aural eczematoid dermatitis, malignant external otitis, subperichondrial hematoma, ceruminomas, impacted cerumen, sebaceous cysts, osteomas, keloids, otalgia, tinnitus, tympanic membrane infection, tympanitis, otic furuncles, petrositis, conductive and sensorineural hearing loss, epidural abscess, lateral sinus thrombosis, subdural empyema, otitic hydrocephalus, Dandy's syndrome, bullous myringitis, diffuse external otitis, foreign bodies, keratosis obturans, otic neoplasm, otomycosis, trauma, acute barotitis media, acute eustachian tube obstruction, postsurgical otalgia, cholesteatoma, infections related to an otic surgical procedure, and complications associated with any of said disorders. The peptides and agonists of the invention can be used alone or in combination therapy to maintain fluid homeostasis in the inner ear. neuronitis (including viral neuronitis), ganglionitis, geniculate The peptides and agonists of the invention can be used alone or in combination therapy to prevent and/or treat disorders associated with fluid and sodium retention, e.g., diseases of the electrolyte-water/electrolyte transport system within the kidney, gut and urogenital system, congestive heart failure, hypertension, hypotension, salt dependent forms of high blood pressure, hepatic edema, and liver cirrhosis. In addition they can be used to facilitate diuresis or control intestinal fluid. The peptides and agonists of the invention can also be used to treat disorders where there is abnormal proliferation of epithelial cells within the kidney (e.g. as in the case of renal cancer).

The peptides and agonists of the invention can be used alone or in combination therapy to prevent and/or treat kidney disease. "Kidney disease" includes renal failure (including acute renal failure), renal insufficiency, nephrotic edema, glomerulonephritis, pyelonephritis, kidney failure, chronic renal failure, nephritis, nephrosis, azotemia, uremia, immune renal disease, acute nephritic syndrome, rapidly progressive nephritic syndrome, nephrotic syndrome, Berger's Disease, chronic nephritic/proteinuric syndrome, tubulointerstital disease, nephrotoxic disorders, renal infarction, atheroembolic renal disease, renal cortical necrosis, malignant nephroangiosclerosis, renal vein thrombosis, renal tubular acidosis, renal glucosuria, nephrogenic diabetes insipidus, Bartter's Syndrome, Liddle's Syndrome, polycystic kidney disease, medullary cystic disease, medullary sponge kidney, hereditary nephritis, and nail-patella syndrome, along with any disease or disorder that relates to the renal system and related disorders, as well as symptoms indicative of, or related to, renal or kidney disease and related disorders.

The peptides and agonists of the invention can be used alone or in combination therapy to prevent or treat polycystic kidney disease. Polycystic kidney disease" "PKD" (also called "polycystic renal disease") refers to a group of disorders characterized by a large number of cysts distributed throughout dramatically enlarged kidneys. The resultant cyst development leads to impairment of kidney function and can eventually cause kidney failure. "PKD" specifically includes autosomal dominant polycystic kidney disease (ADPKD) and recessive autosomal recessive polycystic kidney disease (ARPKD), in all stages of development, regardless of the underlying cause.

The peptides and agonists of the invention can be used alone or in combination therapy to prevent and/or treat disorders associated with bicarbonate secretion, e.g., Cystic Fibrosis. The peptides and agonists of the invention can be used alone or in combination therapy to prevent and/or treat disorders associated with bile secretion. In addition, they can be used to facilitate or control chloride and bile fluid secretion in the gall bladder.

The peptides and agonists of the invention can be used alone or in combination therapy to prevent and/or treat disorders associated with liver cell regeneration. This may include administration of the peptides and agonists to liver transplant recipients and to patients with drug or alcohol induced-liver damage. Furthermore, the peptides and agonists may be useful to treat liver damage as in the case of viral mediated hepatitis. The peptides and agonists of the invention may be used alone or in combination to prevent and/or treat liver abscess, liver cancer (either primary or metastatic), cirrhosis (such as cirrhosis caused by the alcohol consumption or primary biliary cirrhosis), amebic liver abscess, autoimmune hepatitis, biliary atresia, coccidioidomycosis disseminated, δ agent (hepatitis δ), hemochromatosis, hepatitis a, hepatitis b, hepatitis c, or any other acute, subacute, fulminant or chronic hepatitis of viral, metabolic or toxic etiology, hepatocellular carcinoma, pyogenic liver abscess, Reye's syndrome, sclerosing cholangitis, Wilson's disease, drug induced hepatotoxicity, or fulminant or acute liver failure. The peptides and agonists may be used in stimulating hepatic regeneration after surgical hepatectomy.

The peptides and agonists of the invention can be used alone or in combination therapy to prevent and/or treat myocardial infraction, diastolic dysfunction, angina pectoris, stable, unstable and variant (Prinzmetal) angina, atherosclerosis, thrombosis, endothelial dysfunction, cardiac edema, stroke, conditions of reduced blood vessel patency, e.g., post-percutaneous transluminal coronary angioplasty (post-PTCA) and peripheral vascular disease.

The peptides and agonists of the invention can be used alone or in combination therapy to prevent and/or treat glaucoma.

The peptides and agonists of the invention can be used alone or in combination therapy to prevent and/or treat immunodeficiency.

The peptides and agonists of the invention can be used alone or in combination therapy to prevent and/or treat bladder outlet obstruction and incontinence.

The peptides and agonists of the invention can be used alone or in combination therapy to prevent and/or treat male (e.g. erectile dysfunction) or female sexual dysfunction, premature labor, and dysmenorrhoea. In certain embodiments they can be used in combination with a phosphodiesterase inhibitor.

The peptides and agonists of the invention can be used alone or in combination therapy to prevent and/or treat osteopenia disorders (bone loss disorders). "Bone loss disorders" include conditions and diseases wherein the inhibition of bone loss and/or the promotion of bone formation is desirable. Among such conditions and diseases are osteoporosis, osteomyelitis, Paget's disease (osteitis deformans), periodontitis, hypercalcemia, osteonecrosis, osteosarcoma, osteolyic metastases, familial expansile osteolysis, prosthetic loosening, periprostetic osteolysis, bone loss attendant rheumatoid arthritis, and cleiodocranial dysplasia (CCD). Osteoporosis includes primary osteoporosis, endocrine osteoporosis (hyperthyroidism, hyperparathyroidism, Cushing's syndrome, and acromegaly), hereditary and congenital forms of osteoporosis (osteogenesis imperfecta, homocystinuria, Menkes' syndrome, and Rile-Day syndrome) and osteoporosis due to immobilization of extremitiesosteomyelitis, or an infectious lesion in bone leading to bone loss. The peptides and agonists can be used alone or in combination therapy to stimulating bone regeneration. The bone regeneration may be following reconstruction of bone defects in craniomaxillofacial surgery, or following an implant into bone, for example a dental implant, bone supporting implant, or prosthesis. The bone regeneration may also be following a bone fracture.

The peptides of the invention that have homology to ST peptides can be used as immunogens to treat and/or prevent one or more disease symptoms associated with traveler's diarrhea. The methods described in US20040146534, U.S. Pat. No. 4,220,584, U.S. Pat. No. 4,285,391, U.S. Pat. No. 5,182,109, U.S. Pat. No. 4,603,049, U.S. Pat. No. 4,545,931, U.S. Pat. No. 4,886,663, and WO08402700 can be similarly used to create immunogens comprising the peptides of the invention.

SEQUENCE LISTING (2084 sequences)

SEQ ID NO: 1 - protein, 21 aa, Artificial Sequence
  Synthetically generated peptide
  VARIANT 8, 9, 12, 13, 14, 16, 17, 19, 20, 21: Xaa = any amino acid
NSSNYCCXXCCXXXCXXCXXX

SEQ ID NO: 2 - protein, 21 aa, Artificial Sequence
  Synthetically generated peptide
  VARIANT 9: Xaa = any amino acid; or Xaa = any amino acid other than Leu; or Xaa = Phe, Trp, and Tyr; or selected from from any other natural or non-natural aromatic amino acid; or Xaa = Tyr
  VARIANT 20, 21: Xaa 20 = Asp, Xaa21 = Phe
NSSNYCCEXCCNPACTGCYXX

SEQ ID NO: 3 - protein, 14 aa, Artificial Sequence
  Synthetically generated peptide
CCEYCCNPACTGCY

SEQ ID NO: 4 - protein, 19 aa, Artificial Sequence
  Synthetically generated peptide
NSSNYCCELCCNPACTGCY

SEQ ID NO: 5 - protein, 19 aa, Artificial Sequence
  Synthetically generated peptide
NSSNYCCEYCCNPACTGCY

SEQ ID NO: 6 - protein, 14 aa, Artificial Sequence
  Synthetically generated peptide
CCELCCNPACTGCY

SEQ ID NO: 7 - protein, 19 aa, Artificial Sequence
  Synthetically generated peptide
NSSNYCCELCCNPACWGCY

SEQ ID NO: 8 - protein, 14 aa, Artificial Sequence
  Synthetically generated peptide
CCELCCNPACWGCY

SEQ ID NO: 9 - protein, 15 aa, Artificial Sequence
  Synthetically generated peptide
NCCELCCNPACTGCY

SEQ ID NO: 10 - protein, 15 aa, Artificial Sequence
  Synthetically generated peptide
NCCELCCNPACWGCY

SEQ ID NO: 11 - protein, 15 aa, Artificial Sequence
  Synthetically generated peptide
NCCEFCCNPACTGCY

SEQ ID NO: 12 - protein, 15 aa, Artificial Sequence
  Synthetically generated peptide
NCCEYCCNPACTGCY

SEQ ID NO: 13 - protein, 15 aa, Artificial Sequence
  Synthetically generated peptide
NCCEWCCNPACTGCY

SEQ ID NO: 14 - protein, 15 aa, Artificial Sequence
  Synthetically generated peptide
NCCERCCNPACTGCY

SEQ ID NO: 15 - protein, 15 aa, Artificial Sequence
  Synthetically generated peptide
NCCEKCCNPACTGCY

SEQ ID NO: 16 - protein, 21 aa, Artificial Sequence
  Synthetically generated peptide
NSSNYCCELCCNPACTGCYDF

SEQ ID NO: 17 - protein, 21 aa, Artificial Sequence
  Synthetically generated peptide
NSSNYCCELCCNPACWGCYDF

SEQ ID NO: 18 - protein, 21 aa, Artificial Sequence
  Synthetically generated peptide
NSSNYCCEFCCNPACTGCYDF

SEQ ID NO: 19 - protein, 21 aa, Artificial Sequence
  Synthetically generated peptide
NSSNYCCEYCCNPACTGCYDF

SEQ ID NO: 20 - protein, 21 aa, Artificial Sequence
  Synthetically generated peptide
NSSNYCCEWCCNPACTGCYDF

SEQ ID NO: 21 - protein, 21 aa, Artificial Sequence
  Synthetically generated peptide
NSSNYCCERCCNPACTGCYDF

SEQ ID NO: 22 - protein, 21 aa, Artificial Sequence
  Synthetically generated peptide
NSSNYCCEKCCNPACTGCYDF

SEQ ID NO: 23 - protein, 16 aa, Artificial Sequence
  Synthetically generated peptide
CCELCCNPACTGCYDF

SEQ ID NO: 24 - protein, 16 aa, Artificial Sequence
  Synthetically generated peptide
CCELCCNPACWGCYDF

SEQ ID NO: 25 - protein, 16 aa, Artificial Sequence
  Synthetically generated peptide
CCEFCCNPACTGCYDF

SEQ ID NO: 26 - protein, 16 aa, Artificial Sequence
  Synthetically generated peptide
CCEYCCNPACTGCYDF

SEQ ID NO: 27 - protein, 16 aa, Artificial Sequence
  Synthetically generated peptide
CCEWCCNPACTGCYDF

SEQ ID NO: 28 - protein, 16 aa, Artificial Sequence
  Synthetically generated peptide
CCERCCNPACTGCYDF

SEQ ID NO: 29 - protein, 16 aa, Artificial Sequence
  Synthetically generated peptide
CCEKCCNPACTGCYDF

SEQ ID NO: 30 - protein, 17 aa, Artificial Sequence
  Synthetically generated peptide
NCCELCCNPACTGCYDF

SEQ ID NO: 31 - protein, 17 aa, Artificial Sequence
  Synthetically generated peptide
NCCELCCNPACWGCYDF

SEQ ID NO: 32 - protein, 17 aa, Artificial Sequence
  Synthetically generated peptide
NCCEFCCNPACTGCYDF

SEQ ID NO: 33 - protein, 17 aa, Artificial Sequence
  Synthetically generated peptide
NCCEYCCNPACTGCYDF

SEQ ID NO: 34 - protein, 17 aa, Artificial Sequence
  Synthetically generated peptide
NCCEWCCNPACTGCYDF

SEQ ID NO: 35 - protein, 17 aa, Artificial Sequence
  Synthetically generated peptide
NCCERCCNPACTGCYDF

SEQ ID NO: 36 - protein, 17 aa, Artificial Sequence
  Synthetically generated peptide
NCCEKCCNPACTGCYDF

SEQ ID NO: 37 - protein, 19 aa, Artificial Sequence
  Synthetically generated peptide
QSSNYCCEYCCNPACTGCY

SEQ ID NO: 38 - protein, 19 aa, Artificial Sequence
  Synthetically generated peptide
NTSNYCCEYCCNPACTGCY

SEQ ID NO: 39 - protein, 19 aa, Artificial Sequence
  Synthetically generated peptide
NLSNYCCEYCCNPACTGCY

SEQ ID NO: 40 - protein, 19 aa, Artificial Sequence
  Synthetically generated peptide
NISNYCCEYCCNPACTGCY

SEQ ID NO: 41 - protein, 19 aa, Artificial Sequence
  Synthetically generated peptide
NSSQYCCEYCCNPACTGCY

SEQ ID NO: 42 - protein, 18 aa, Artificial Sequence
  Synthetically generated peptide
SSNYCCEYCCNPACTGCY

SEQ ID NO: 43 - protein, 19 aa, Artificial Sequence
  Synthetically generated peptide
QSSQYCCEYCCNPACTGCY

SEQ ID NO: 44 - protein, 18 aa, Artificial Sequence
  Synthetically generated peptide
SSQYCCEYCCNPACTGCY

SEQ ID NO: 45 - protein, 19 aa, Artificial Sequence
  Synthetically generated peptide
NSSNYCCEACCNPACTGCY

SEQ ID NO: 46 - protein, 19 aa, Artificial Sequence
  Synthetically generated peptide
NSSNYCCERCCNPACTGCY

SEQ ID NO: 47 - protein, 19 aa, Artificial Sequence
  Synthetically generated peptide
NSSNYCCENCCNPACTGCY

SEQ ID NO: 48 - protein, 19 aa, Artificial Sequence
  Synthetically generated peptide
NSSNYCCEDCCNPACTGCY

SEQ ID NO: 49 - protein, 19 aa, Artificial Sequence
  Synthetically generated peptide
NSSNYCCECCCNPACTGCY

SEQ ID NO: 50 - protein, 19 aa, Artificial Sequence
  Synthetically generated peptide
NSSNYCCEQCCNPACTGCY

SEQ ID NO: 51 - protein, 19 aa, Artificial Sequence
  Synthetically generated peptide
NSSNYCCEECCNPACTGCY

SEQ ID NO: 52 - protein, 19 aa, Artificial Sequence
  Synthetically generated peptide
NSSNYCCEGCCNPACTGCY

SEQ ID NO: 53 - protein, 19 aa, Artificial Sequence
  Synthetically generated peptide
NSSNYCCEHCCNPACTGCY

SEQ ID NO: 54 - protein, 19 aa, Artificial Sequence
  Synthetically generated peptide
NSSNYCCEICCNPACTGCY

SEQ ID NO: 55 - protein, 19 aa, Artificial Sequence
  Synthetically generated peptide
NSSNYCCEKCCNPACTGCY

SEQ ID NO: 56 - protein, 19 aa, Artificial Sequence
  Synthetically generated peptide
NSSNYCCEMCCNPACTGCY

SEQ ID NO: 57 - protein, 19 aa, Artificial Sequence
  Synthetically generated peptide
NSSNYCCEFCCNPACTGCY

SEQ ID NO: 58 - protein, 19 aa, Artificial Sequence
  Synthetically generated peptide
NSSNYCCEPCCNPACTGCY

SEQ ID NO: 59 - protein, 19 aa, Artificial Sequence
  Synthetically generated peptide
NSSNYCCESCCNPACTGCY

SEQ ID NO: 60 - protein, 19 aa, Artificial Sequence
  Synthetically generated peptide
NSSNYCCETCCNPACTGCY

SEQ ID NO: 61 - protein, 19 aa, Artificial Sequence
  Synthetically generated peptide
NSSNYCCEWCCNPACTGCY

SEQ ID NO: 62 - protein, 19 aa, Artificial Sequence
  Synthetically generated peptide
NSSNYCCEVCCNPACTGCY

SEQ ID NO: 63 - protein, 14 aa, Artificial Sequence
  Synthetically generated peptide
CCEACCNPACTGCY

SEQ ID NO: 64 - protein, 14 aa, Artificial Sequence
  Synthetically generated peptide
CCERCCNPACTGCY

SEQ ID NO: 65 - protein, 14 aa, Artificial Sequence
  Synthetically generated peptide
CCENCCNPACTGCY

SEQ ID NO: 66 - protein, 14 aa, Artificial Sequence
  Synthetically generated peptide
CCEDCCNPACTGCY

SEQ ID NO: 67 - protein, 14 aa, Artificial Sequence
  Synthetically generated peptide
CCECCCNPACTGCY

SEQ ID NO: 68 - protein, 14 aa, Artificial Sequence
  Synthetically generated peptide
CCEQCCNPACTGCY

SEQ ID NO: 69 - protein, 14 aa, Artificial Sequence
  Synthetically generated peptide
CCEECCNPACTGCY

SEQ ID NO: 70 - protein, 14 aa, Artificial Sequence
  Synthetically generated peptide
CCEGCCNPACTGCY

SEQ ID NO: 71 - protein, 14 aa, Artificial Sequence
  Synthetically generated peptide
CCEHCCNPACTGCY

SEQ ID NO: 72 - protein, 14 aa, Artificial Sequence
  Synthetically generated peptide
CCEICCNPACTGCY

SEQ ID NO: 73 - protein, 14 aa, Artificial Sequence
  Synthetically generated peptide
CCEKCCNPACTGCY

SEQ ID NO: 74 - protein, 14 aa, Artificial Sequence
  Synthetically generated peptide
CCEMCCNPACTGCY

SEQ ID NO: 75 - protein, 14 aa, Artificial Sequence
  Synthetically generated peptide
CCEFCCNPACTGCY

SEQ ID NO: 76 - protein, 14 aa, Artificial Sequence
  Synthetically generated peptide
CCEPCCNPACTGCY

SEQ ID NO: 77 - protein, 14 aa, Artificial Sequence
  Synthetically generated peptide
CCESCCNPACTGCY

SEQ ID NO: 78 - protein, 14 aa, Artificial Sequence
  Synthetically generated peptide
CCETCCNPACTGCY

SEQ ID NO: 79 - protein, 14 aa, Artificial Sequence
  Synthetically generated peptide
CCEWCCNPACTGCY

SEQ ID NO: 80 - protein, 14 aa, Artificial Sequence
  Synthetically generated peptide
CCEVCCNPACTGCY

SEQ ID NO: 81 - protein, 13 aa, Artificial Sequence
  Synthetically generated peptide
CCEYCCNPACTGC

SEQ ID NO: 82 - protein, 13 aa, Artificial Sequence
  Synthetically generated peptide
CCEACCNPACTGC

SEQ ID NO: 83 - protein, 13 aa, Artificial Sequence
  Synthetically generated peptide
CCERCCNPACTGC

SEQ ID NO: 84 - protein, 13 aa, Artificial Sequence
  Synthetically generated peptide
CCENCCNPACTGC

SEQ ID NO: 85 - protein, 13 aa, Artificial Sequence
  Synthetically generated peptide
CCEDCCNPACTGC

SEQ ID NO: 86 - protein, 13 aa, Artificial Sequence
  Synthetically generated peptide
CCECCCNPACTGC

SEQ ID NO: 87 - protein, 13 aa, Artificial Sequence
  Synthetically generated peptide
CCEQCCNPACTGC

SEQ ID NO: 88 - protein, 13 aa, Artificial Sequence
  Synthetically generated peptide
CCEECCNPACTGC

SEQ ID NO: 89 - protein, 13 aa, Artificial Sequence
  Synthetically generated peptide
CCEGCCNPACTGC

SEQ ID NO: 90 - protein, 13 aa, Artificial Sequence
  Synthetically generated peptide
CCEHCCNPACTGC

SEQ ID NO: 91 - protein, 13 aa, Artificial Sequence
  Synthetically generated peptide
CCEICCNPACTGC

SEQ ID NO: 92 - protein, 13 aa, Artificial Sequence
  Synthetically generated peptide
CCEKCCNPACTGC

SEQ ID NO: 93 - protein, 13 aa, Artificial Sequence
  Synthetically generated peptide
CCEMCCNPACTGC

SEQ ID NO: 94 - protein, 13 aa, Artificial Sequence
  Synthetically generated peptide
CCEFCCNPACTGC

SEQ ID NO: 95 - protein, 13 aa, Artificial Sequence
  Synthetically generated peptide
CCEPCCNPACTGC

SEQ ID NO: 96 - protein, 13 aa, Artificial Sequence
  Synthetically generated peptide
CCESCCNPACTGC

SEQ ID NO: 97 - protein, 13 aa, Artificial Sequence
  Synthetically generated peptide
CCETCCNPACTGC

SEQ ID NO: 98 - protein, 13 aa, Artificial Sequence
  Synthetically generated peptide
CCEWCCNPACTGC

SEQ ID NO: 99 - protein, 13 aa, Artificial Sequence
  Synthetically generated peptide
CCEVCCNPACTGC

SEQ ID NO: 100 - protein, 19 aa, Escherichia coli
NSSNYCCELCCNPACTGCY

SEQ ID NO: 101 - protein, 18 aa, Escherichia coli
NTFYCCELCCNPACAGCY

SEQ ID NO: 102 - protein, 18 aa, Escherichia coli
NTFYCCELCCYPACAGCN

SEQ ID NO: 103 - protein, 18 aa, Citrobacter freundii
NTFYCCELCCNPACAGCY

SEQ ID NO: 104 - protein, 30 aa, Yersinia enterocolitica
QACDPPSPPAEVSSDWDCCDVCCNPACAGC

SEQ ID NO: 105 - protein, 30 aa, Yersinia enterocolitica
QACDPPLPPAEVSSDWDCCDVCCNPACAGC

SEQ ID NO: 106 - protein, 30 aa, Yersinia enterocolitica
KACDTQTPSPSEENDDWCCEVCCNPACAGC

SEQ ID NO: 107 - protein, 53 aa, Yersinia enterocolitica
QETASGQVGDVSSSTIATEVSEAECGTQSATTQGENDWDWCCELCCNPACFGC

SEQ ID NO: 108 - protein, 16 aa, Yersinia kristensenii
SDWCCEVCCNPACAGC

SEQ ID NO: 109 - protein, 17 aa, Vibrio cholerae
IDCCEICCNPACFGCLN

SEQ ID NO: 110 - protein, 17 aa, Vibrio mimicus
IDCCEICCNPACFGCLN

SEQ ID NO: 111 - protein, 18 aa, Escherichia coli
NTFYCCELCCNPACAPCY

SEQ ID NO: 112 - protein, 13 aa, Vibrio cholerae
IDCCEICCNPACF

SEQ ID NO: 113 - protein, 14 aa, Vibrio cholerae
IDCCEICCNPACFG

SEQ ID NO: 114 - protein, 17 aa, Vibrio mimicus
IDCCEICCNPACFGCLN

SEQ ID NO: 115 - protein, 17 aa, Vibrio mimicus
IDRCEICCNPACFGCLN

SEQ ID NO: 116 - protein, 16 aa, Yersinia enterocolitica
DWDCCDVCCNPACAGC

SEQ ID NO: 117 - protein, 16 aa, Yersinia enterocolitica
DWDCCDVCCNPACAGC

SEQ ID NO: 118 - protein, 17 aa, Yersinia enterocolitica
NDDWCCEVCCNPACAGC

SEQ ID NO: 119 - protein, 16 aa, Yersinia enterocolitica
WDWCCELCCNPACFGC

SEQ ID NO: 120 - protein, 30 aa, Yersinia enterocolitica
QACDPPSPPAEVSSDWDCCDVCCDPACAGC

SEQ ID NO: 121 - protein, 72 aa, Escherichia coli
MKKLMLAIFISVLSFPSFSQSTESLDSSKEKITLETKKCDVVKNNSEKKSENMNNTFYCCELCCNPACAGCY

SEQ ID NO: 122 - protein, 72 aa, Escherichia coli
MKKSILFIFLSVLSFSPFAQDAKPVESSKEKITLESKKCNIAKKSNKSGPESMNSSNYCCELCCNPACTGCY

SEQ ID NO: 123 - protein, 71 aa, Yersinia enterocolitica
MKKIVFVLVLMLSSFGAFGQETVSGQFSDALSTPITAEVYKQACDPPLPPAEVSSDWDCCDVCCNPACAGC

SEQ ID NO: 124 - protein, 53 aa, Artificial Sequence
  Synthetically generated peptide
MKKSILFIFLSVLSFSPFAQDAKPAGSSKEKITLESKKCNIVKKSNKSGPESM

SEQ ID NO: 125 - protein, 53 aa, Escherichia coli
MKKSILFIFLSVLSFSPFAQDAKPAGSSKEKITLESKKCNIVKKNNESSPESM

SEQ ID NO: 126 - protein, 5 aa, Artificial Sequence
  Synthetically generated peptide
NSSNY

SEQ ID NO: 127 - protein, 6 aa, Artificial Sequence
  Synthetically generated peptide
KKKKKK

SEQ ID NO: 128 - protein, 7 aa, Artificial Sequence
  Synthetically generated peptide
DKKKKKK

SEQ ID NO: 129 - protein, 21 aa, Artificial Sequence
  Synthetically generated peptide
  VARIANT 8: Xaa = Glu or Asp
  VARIANT 9: Xaa = Leu, Ile, Val, Trp, Tyr or Phe
  VARIANT 16: Xaa =  Thr, Ala, or Trp
  VARIANT 19: Xaa = Trp, Tyr
  VARIANT 20, 21: Xaa = Asp, Phe
NSSNYCCXXCCNPACXGCXXX

SEQ ID NO: 130 - protein, 13 aa, Artificial Sequence
  Synthetically generated peptide
CCYCCNPACTGCY

SEQ ID NO: 131 - protein, 12 aa, Artificial Sequence
  Synthetically generated peptide
CCCCNPACTGCY

SEQ ID NO: 132 - protein, 11 aa, Artificial Sequence
  Synthetically generated peptide
CCCCPACTGCY

SEQ ID NO: 133 - protein, 10 aa, Artificial Sequence
  Synthetically generated peptide
CCCCACTGCY

SEQ ID NO: 134 - protein, 10 aa, Artificial Sequence
  Synthetically generated peptide
CCCCPCTGCY

SEQ ID NO: 135 - protein, 10 aa, Artificial Sequence
  Synthetically generated peptide
CCCCPACGCY

SEQ ID NO: 136 - protein, 10 aa, Artificial Sequence
  Synthetically generated peptide
CCCCPACTCY

SEQ ID NO: 137 - protein, 10 aa, Artificial Sequence
  Synthetically generated peptide
CCCCPACTGC

SEQ ID NO: 138 - protein, 11 aa, Artificial Sequence
  Synthetically generated peptide
CCCCNACTGCY

SEQ ID NO: 139 - protein, 10 aa, Artificial Sequence
  Synthetically generated peptide
CCCCNCTGCY

SEQ ID NO: 140 - protein, 10 aa, Artificial Sequence
  Synthetically generated peptide
CCCCNACGCY

SEQ ID NO: 141 - protein, 10 aa, Artificial Sequence
  Synthetically generated peptide
CCCCNACTCY

SEQ ID NO: 142 - protein, 10 aa, Artificial Sequence
  Synthetically generated peptide
CCCCNACTGC

SEQ ID NO: 143 - protein, 11 aa, Artificial Sequence
  Synthetically generated peptide
CCCCNPCTGCY

SEQ ID NO: 144 - protein, 10 aa, Artificial Sequence
  Synthetically generated peptide
CCCCNPCGCY

SEQ ID NO: 145 - protein, 10 aa, Artificial Sequence
  Synthetically generated peptide
CCCCNPCTCY

SEQ ID NO: 146 - protein, 10 aa, Artificial Sequence
  Synthetically generated peptide
CCCCNPCTGC

SEQ ID NO: 147 - protein, 11 aa, Artificial Sequence
  Synthetically generated peptide
CCCCNPACGCY

SEQ ID NO: 148 - protein, 10 aa, Artificial Sequence
  Synthetically generated peptide
CCCCNPACCY

SEQ ID NO: 149 - protein, 10 aa, Artificial Sequence
  Synthetically generated peptide
CCCCNPACGC

SEQ ID NO: 150 - protein, 11 aa, Artificial Sequence
  Synthetically generated peptide
CCCCNPACTCY

SEQ ID NO: 151 - protein, 10 aa, Artificial Sequence
  Synthetically generated peptide
CCCCNPACTC

SEQ ID NO: 152 - protein, 11 aa, Artificial Sequence
  Synthetically generated peptide
CCCCNPACTGC

SEQ ID NO: 153 - protein, 12 aa, Artificial Sequence
  Synthetically generated peptide
CCYCCPACTGCY

SEQ ID NO: 154 - protein, 11 aa, Artificial Sequence
  Synthetically generated peptide
CCYCCACTGCY

SEQ ID NO: 155 - protein, 10 aa, Artificial Sequence
  Synthetically generated peptide
CCYCCCTGCY

SEQ ID NO: 156 - protein, 10 aa, Artificial Sequence
  Synthetically generated peptide
CCYCCACGCY

SEQ ID NO: 157 - protein, 10 aa, Artificial Sequence
  Synthetically generated peptide
CCYCCACTCY

SEQ ID NO: 158 - protein, 10 aa, Artificial Sequence
  Synthetically generated peptide
CCYCCACTGC

SEQ ID NO: 159 - protein, 11 aa, Artificial Sequence
  Synthetically generated peptide
CCYCCPCTGCY

SEQ ID NO: 160 - protein, 10 aa, Artificial Sequence
  Synthetically generated peptide
CCYCCPCGCY

SEQ ID NO: 161 - protein, 10 aa, Artificial Sequence
  Synthetically generated peptide
CCYCCPCTCY

SEQ ID NO: 162 - protein, 10 aa, Artificial Sequence
  Synthetically generated peptide
CCYCCPCTGC

SEQ ID NO: 163 - protein, 11 aa, Artificial Sequence
  Synthetically generated peptide
CCYCCPACGCY

SEQ ID NO: 164 - protein, 10 aa, Artificial Sequence
  Synthetically generated peptide
CCYCCPACCY

SEQ ID NO: 165 - protein, 10 aa, Artificial Sequence
  Synthetically generated peptide
CCYCCPACGC

SEQ ID NO: 166 - protein, 11 aa, Artificial Sequence
  Synthetically generated peptide
CCYCCPACTCY

SEQ ID NO: 167 - protein, 10 aa, Artificial Sequence
  Synthetically generated peptide
CCYCCPACTC

SEQ ID NO: 168 - protein, 11 aa, Artificial Sequence
  Synthetically generated peptide
CCYCCPACTGC

SEQ ID NO: 169 - protein, 12 aa, Artificial Sequence
  Synthetically generated peptide
CCYCCNACTGCY

SEQ ID NO: 170 - protein, 11 aa, Artificial Sequence
  Synthetically generated peptide
CCYCCNCTGCY

SEQ ID NO: 171 - protein, 10 aa, Artificial Sequence
  Synthetically generated peptide
CCYCCNCGCY

SEQ ID NO: 172 - protein, 10 aa, Artificial Sequence
  Synthetically generated peptide
CCYCCNCTCY

SEQ ID NO: 173 - protein, 10 aa, Artificial Sequence
  Synthetically generated peptide
CCYCCNCTGC

SEQ ID NO: 174 - protein, 11 aa, Artificial Sequence
  Synthetically generated peptide
CCYCCNACGCY

SEQ ID NO: 175 - protein, 10 aa, Artificial Sequence
  Synthetically generated peptide
CCYCCNACCY

SEQ ID NO: 176 - protein, 10 aa, Artificial Sequence
  Synthetically generated peptide
CCYCCNACGC

SEQ ID NO: 177 - protein, 11 aa, Artificial Sequence
  Synthetically generated peptide
CCYCCNACTCY

SEQ ID NO: 178 - protein, 10 aa, Artificial Sequence
  Synthetically generated peptide
CCYCCNACTC

SEQ ID NO: 179 - protein, 11 aa, Artificial Sequence
  Synthetically generated peptide
CCYCCNACTGC

SEQ ID NO: 180 - protein, 12 aa, Artificial Sequence
  Synthetically generated peptide
CCYCCNPCTGCY

SEQ ID NO: 181 - protein, 11 aa, Artificial Sequence
  Synthetically generated peptide
CCYCCNPCGCY

SEQ ID NO: 182 - protein, 10 aa, Artificial Sequence
  Synthetically generated peptide
CCYCCNPCCY

SEQ ID NO: 183 - protein, 10 aa, Artificial Sequence
  Synthetically generated peptide
CCYCCNPCGC

SEQ ID NO: 184 - protein, 11 aa, Artificial Sequence
  Synthetically generated peptide
CCYCCNPCTCY

SEQ ID NO: 185 - protein, 10 aa, Artificial Sequence
  Synthetically generated peptide
CCYCCNPCTC

SEQ ID NO: 186 - protein, 11 aa, Artificial Sequence
  Synthetically generated peptide
CCYCCNPCTGC

SEQ ID NO: 187 - protein, 12 aa, Artificial Sequence
  Synthetically generated peptide
CCYCCNPACGCY

SEQ ID NO: 188 - protein, 11 aa, Artificial Sequence
  Synthetically generated peptide
CCYCCNPACCY

SEQ ID NO: 189 - protein, 10 aa, Artificial Sequence
  Synthetically generated peptide
CCYCCNPACC

SEQ ID NO: 190 - protein, 11 aa, Artificial Sequence
  Synthetically generated peptide
CCYCCNPACGC

SEQ ID NO: 191 - protein, 12 aa, Artificial Sequence
  Synthetically generated peptide
CCYCCNPACTCY

SEQ ID NO: 192 - protein, 11 aa, Artificial Sequence
  Synthetically generated peptide
CCYCCNPACTC

SEQ ID NO: 193 - protein, 12 aa, Artificial Sequence
  Synthetically generated peptide
CCYCCNPACTGC

SEQ ID NO: 194 - protein, 13 aa, Artificial Sequence
  Synthetically generated peptide
CCECCNPACTGCY

SEQ ID NO: 195 - protein, 12 aa, Artificial Sequence
  Synthetically generated peptide
CCECCPACTGCY

SEQ ID NO: 196 - protein, 11 aa, Artificial Sequence
  Synthetically generated peptide
CCECCACTGCY

SEQ ID NO: 197 - protein, 10 aa, Artificial Sequence
  Synthetically generated peptide
CCECCCTGCY

SEQ ID NO: 198 - protein, 10 aa, Artificial Sequence
  Synthetically generated peptide
CCECCACGCY

SEQ ID NO: 199 - protein, 10 aa, Artificial Sequence
  Synthetically generated peptide
CCECCACTCY

SEQ ID NO: 200 - protein, 10 aa, Artificial Sequence
  Synthetically generated peptide
CCECCACTGC

SEQ ID NO: 201 - protein, 11 aa, Artificial Sequence
  Synthetically generated peptide
CCECCPCTGCY

SEQ ID NO: 202 - protein, 10 aa, Artificial Sequence
  Synthetically generated peptide
CCECCPCGCY

SEQ ID NO: 203 - protein, 10 aa, Artificial Sequence
  Synthetically generated peptide
CCECCPCTCY

SEQ ID NO: 204 - protein, 10 aa, Artificial Sequence
  Synthetically generated peptide
CCECCPCTGC

SEQ ID NO: 205 - protein, 11 aa, Artificial Sequence
  Synthetically generated peptide
CCECCPACGCY

SEQ ID NO: 206 - protein, 10 aa, Artificial Sequence
  Synthetically generated peptide
CCECCPACCY

SEQ ID NO: 207 - protein, 10 aa, Artificial Sequence
  Synthetically generated peptide
CCECCPACGC

SEQ ID NO: 208 - protein, 11 aa, Artificial Sequence
  Synthetically generated peptide
CCECCPACTCY

SEQ ID NO: 209 - protein, 10 aa, Artificial Sequence
  Synthetically generated peptide
CCECCPACTC

SEQ ID NO: 210 - protein, 11 aa, Artificial Sequence
  Synthetically generated peptide
CCECCPACTGC

SEQ ID NO: 211 - protein, 12 aa, Artificial Sequence
  Synthetically generated peptide
CCECCNACTGCY

SEQ ID NO: 212 - protein, 11 aa, Artificial Sequence
  Synthetically generated peptide
CCECCNCTGCY

SEQ ID NO: 213 - protein, 10 aa, Artificial Sequence
  Synthetically generated peptide
CCECCNCGCY

SEQ ID NO: 214 - protein, 10 aa, Artificial Sequence
  Synthetically generated peptide
CCECCNCTCY

SEQ ID NO: 215 - protein, 10 aa, Artificial Sequence
  Synthetically generated peptide
CCECCNCTGC

SEQ ID NO: 216 - protein, 11 aa, Artificial Sequence
  Synthetically generated peptide
CCECCNACGCY

SEQ ID NO: 217 - protein, 10 aa, Artificial Sequence
  Synthetically generated peptide
CCECCNACCY

SEQ ID NO: 218 - protein, 10 aa, Artificial Sequence
  Synthetically generated peptide
CCECCNACGC

SEQ ID NO: 219 - protein, 11 aa, Artificial Sequence
  Synthetically generated peptide
CCECCNACTCY

SEQ ID NO: 220 - protein, 10 aa, Artificial Sequence
  Synthetically generated peptide
CCECCNACTC

SEQ ID NO: 221 - protein, 11 aa, Artificial Sequence
  Synthetically generated peptide
CCECCNACTGC

SEQ ID NO: 222 - protein, 12 aa, Artificial Sequence
  Synthetically generated peptide
CCECCNPCTGCY

SEQ ID NO: 223 - protein, 11 aa, Artificial Sequence
  Synthetically generated peptide
CCECCNPCGCY

SEQ ID NO: 224 - protein, 10 aa, Artificial Sequence
  Synthetically generated peptide
CCECCNPCCY

SEQ ID NO: 225 - protein, 10 aa, Artificial Sequence
  Synthetically generated peptide
CCECCNPCGC

SEQ ID NO: 226 - protein, 11 aa, Artificial Sequence
  Synthetically generated peptide
CCECCNPCTCY

SEQ ID NO: 227 - protein, 10 aa, Artificial Sequence
  Synthetically generated peptide
CCECCNPCTC

SEQ ID NO: 228 - protein, 11 aa, Artificial Sequence
  Synthetically generated peptide
CCECCNPCTGC

SEQ ID NO: 229 - protein, 12 aa, Artificial Sequence
  Synthetically generated peptide
CCECCNPACGCY

SEQ ID NO: 230 - protein, 11 aa, Artificial Sequence
  Synthetically generated peptide
CCECCNPACCY

SEQ ID NO: 231 - protein, 10 aa, Artificial Sequence
  Synthetically generated peptide
CCECCNPACC

SEQ ID NO: 232 - protein, 11 aa, Artificial Sequence
  Synthetically generated peptide
CCECCNPACGC

SEQ ID NO: 233 - protein, 12 aa, Artificial Sequence
  Synthetically generated peptide
CCECCNPACTCY

SEQ ID NO: 234 - protein, 11 aa, Artificial Sequence
  Synthetically generated peptide
CCECCNPACTC

SEQ ID NO: 235 - protein, 12 aa, Artificial Sequence
  Synthetically generated peptide
CCECCNPACTGC

SEQ ID NO: 236 - protein, 13 aa, Artificial Sequence
  Synthetically generated peptide
CCEYCCPACTGCY

SEQ ID NO: 237 - protein, 12 aa, Artificial Sequence
  Synthetically generated peptide
CCEYCCACTGCY

SEQ ID NO: 238 - protein, 11 aa, Artificial Sequence
  Synthetically generated peptide
CCEYCCCTGCY

SEQ ID NO: 239 - protein, 10 aa, Artificial Sequence
  Synthetically generated peptide
CCEYCCCGCY

SEQ ID NO: 240 - protein, 10 aa, Artificial Sequence
  Synthetically generated peptide
CCEYCCCTCY

SEQ ID NO: 241 - protein, 10 aa, Artificial Sequence
  Synthetically generated peptide
CCEYCCCTGC

SEQ ID NO: 242 - protein, 11 aa, Artificial Sequence
  Synthetically generated peptide
CCEYCCACGCY

SEQ ID NO: 243 - protein, 10 aa, Artificial Sequence
  Synthetically generated peptide
CCEYCCACCY

SEQ ID NO: 244 - protein, 10 aa, Artificial Sequence
  Synthetically generated peptide
CCEYCCACGC

SEQ ID NO: 245 - protein, 11 aa, Artificial Sequence
  Synthetically generated peptide
CCEYCCACTCY

SEQ ID NO: 246 - protein, 10 aa, Artificial Sequence
  Synthetically generated peptide
CCEYCCACTC

SEQ ID NO: 247 - protein, 11 aa, Artificial Sequence
  Synthetically generated peptide
CCEYCCACTGC

SEQ ID NO: 248 - protein, 12 aa, Artificial Sequence
  Synthetically generated peptide
CCEYCCPCTGCY

SEQ ID NO: 249 - protein, 11 aa, Artificial Sequence
  Synthetically generated peptide
CCEYCCPCGCY

SEQ ID NO: 250 - protein, 10 aa, Artificial Sequence
  Synthetically generated peptide
CCEYCCPCCY

SEQ ID NO: 251 - protein, 10 aa, Artificial Sequence
  Synthetically generated peptide
CCEYCCPCGC

SEQ ID NO: 252 - protein, 11 aa, Artificial Sequence
  Synthetically generated peptide
CCEYCCPCTCY

SEQ ID NO: 253 - protein, 10 aa, Artificial Sequence
  Synthetically generated peptide
CCEYCCPCTC

SEQ ID NO: 254 - protein, 11 aa, Artificial Sequence
  Synthetically generated peptide
CCEYCCPCTGC

SEQ ID NO: 255 - protein, 12 aa, Artificial Sequence
  Synthetically generated peptide
CCEYCCPACGCY

SEQ ID NO: 256 - protein, 11 aa, Artificial Sequence
  Synthetically generated peptide
CCEYCCPACCY

SEQ ID NO: 257 - protein, 10 aa, Artificial Sequence
  Synthetically generated peptide
CCEYCCPACC

SEQ ID NO: 258 - protein, 11 aa, Artificial Sequence
  Synthetically generated peptide
CCEYCCPACGC

SEQ ID NO: 259 - protein, 12 aa, Artificial Sequence
  Synthetically generated peptide
CCEYCCPACTCY

SEQ ID NO: 260 - protein, 11 aa, Artificial Sequence
  Synthetically generated peptide
CCEYCCPACTC

SEQ ID NO: 261 - protein, 12 aa, Artificial Sequence
  Synthetically generated peptide
CCEYCCPACTGC

SEQ ID NO: 262 - protein, 13 aa, Artificial Sequence
  Synthetically generated peptide
CCEYCCNACTGCY

SEQ ID NO: 263 - protein, 12 aa, Artificial Sequence
  Synthetically generated peptide
CCEYCCNCTGCY

SEQ ID NO: 264 - protein, 11 aa, Artificial Sequence
  Synthetically generated peptide
CCEYCCNCGCY

SEQ ID NO: 265 - protein, 10 aa, Artificial Sequence
  Synthetically generated peptide
CCEYCCNCCY

SEQ ID NO: 266 - protein, 10 aa, Artificial Sequence
  Synthetically generated peptide
CCEYCCNCGC

SEQ ID NO: 267 - protein, 11 aa, Artificial Sequence
  Synthetically generated peptide
CCEYCCNCTCY

SEQ ID NO: 268 - protein, 10 aa, Artificial Sequence
  Synthetically generated peptide
CCEYCCNCTC

SEQ ID NO: 269 - protein, 11 aa, Artificial Sequence
  Synthetically generated peptide
CCEYCCNCTGC

SEQ ID NO: 270 - protein, 12 aa, Artificial Sequence
  Synthetically generated peptide
CCEYCCNACGCY

SEQ ID NO: 271 - protein, 11 aa, Artificial Sequence
  Synthetically generated peptide
CCEYCCNACCY

SEQ ID NO: 272 - protein, 10 aa, Artificial Sequence
  Synthetically generated peptide
CCEYCCNACC

SEQ ID NO: 273 - protein, 11 aa, Artificial Sequence
  Synthetically generated peptide
CCEYCCNACGC

SEQ ID NO: 274 - protein, 12 aa, Artificial Sequence
  Synthetically generated peptide
CCEYCCNACTCY

SEQ ID NO: 275 - protein, 11 aa, Artificial Sequence
  Synthetically generated peptide
CCEYCCNACTC

SEQ ID NO: 276 - protein, 12 aa, Artificial Sequence
  Synthetically generated peptide
CCEYCCNACTGC

SEQ ID NO: 277 - protein, 13 aa, Artificial Sequence
  Synthetically generated peptide
CCEYCCNPCTGCY

SEQ ID NO: 278 - protein, 12 aa, Artificial Sequence
  Synthetically generated peptide
CCEYCCNPCGCY

SEQ ID NO: 279 - protein, 11 aa, Artificial Sequence
  Synthetically generated peptide
CCEYCCNPCCY

SEQ ID NO: 280 - protein, 10 aa, Artificial Sequence
  Synthetically generated peptide
CCEYCCNPCC

SEQ ID NO: 281 - protein, 11 aa, Artificial Sequence
  Synthetically generated peptide
CCEYCCNPCGC

SEQ ID NO: 282 - protein, 12 aa, Artificial Sequence
  Synthetically generated peptide
CCEYCCNPCTCY

SEQ ID NO: 283 - protein, 11 aa, Artificial Sequence
  Synthetically generated peptide
CCEYCCNPCTC

SEQ ID NO: 284 - protein, 12 aa, Artificial Sequence
  Synthetically generated peptide
CCEYCCNPCTGC

SEQ ID NO: 285 - protein, 13 aa, Artificial Sequence
  Synthetically generated peptide
CCEYCCNPACGCY

SEQ ID NO: 286 - protein, 12 aa, Artificial Sequence
  Synthetically generated peptide
CCEYCCNPACCY

SEQ ID NO: 287 - protein, 11 aa, Artificial Sequence
  Synthetically generated peptide
CCEYCCNPACC

SEQ ID NO: 288 - protein, 12 aa, Artificial Sequence
  Synthetically generated peptide
CCEYCCNPACGC

SEQ ID NO: 289 - protein, 13 aa, Artificial Sequence
  Synthetically generated peptide
CCEYCCNPACTCY

SEQ ID NO: 290 - protein, 12 aa, Artificial Sequence
  Synthetically generated peptide
CCEYCCNPACTC

SEQ ID NO: 291 - protein, 13 aa, Artificial Sequence
  Synthetically generated peptide
CCEYCCNPACTGC

SEQ ID NO: 292 - protein, 13 aa, Artificial Sequence
  Synthetically generated peptide
  VARIANT 1: Xaa = Any Amino Acid
XEYCCNPACTGCY

SEQ ID NO: 293 - protein, 16 aa, Artificial Sequence
  Synthetically generated peptide
  VARIANT 3, 4: Xaa = Any Amino Acid
CCXXEYCCNPACTGCY

SEQ ID NO: 294 - protein, 17 aa, Artificial Sequence
  Synthetically generated peptide
  VARIANT 3, 4, 5: Xaa = Any Amino Acid
CCXXXEYCCNPACTGCY

SEQ ID NO: 295 - protein, 18 aa, Artificial Sequence
  Synthetically generated peptide
  VARIANT 3, 4, 5, 6: Xaa = Any Amino Acid
CCXXXXEYCCNPACTGCY

SEQ ID NO: 296 - protein, 18 aa, Artificial Sequence
  Synthetically generated peptide
  VARIANT 3, 4, 5, 7: Xaa = Any Amino Acid
CCXXXEXYCCNPACTGCY

SEQ ID NO: 297 - protein, 18 aa, Artificial Sequence
  Synthetically generated peptide
  VARIANT 3, 4, 5, 8: Xaa = Any Amino Acid
CCXXXEYXCCNPACTGCY

SEQ ID NO: 298 - protein, 18 aa, Artificial Sequence
  Synthetically generated peptide
  VARIANT 3, 4, 5, 10: Xaa = Any Amino Acid
CCXXXEYCCXNPACTGCY

SEQ ID NO: 299 - protein, 18 aa, Artificial Sequence
  Synthetically generated peptide
  VARIANT 3, 4, 5, 11: Xaa = Any Amino Acid
CCXXXEYCCNXPACTGCY

SEQ ID NO: 300 - protein, 18 aa, Artificial Sequence
  Synthetically generated peptide
  VARIANT 3, 4, 5, 12: Xaa = Any Amino Acid
CCXXXEYCCNPXACTGCY

SEQ ID NO: 301 - protein, 18 aa, Artificial Sequence
  Synthetically generated peptide
  VARIANT 3, 4, 5, 13: Xaa = Any Amino Acid
CCXXXEYCCNPAXCTGCY

SEQ ID NO: 302 - protein, 18 aa, Artificial Sequence
  Synthetically generated peptide
  VARIANT 3, 4, 5, 14: Xaa = Any Amino Acid
CCXXXEYCCNPACXTGCY

SEQ ID NO: 303 - protein, 18 aa, Artificial Sequence
  Synthetically generated peptide
  VARIANT 3, 4, 5, 15: Xaa = Any Amino Acid
CCXXXEYCCNPACTXGCY

SEQ ID NO: 304 - protein, 18 aa, Artificial Sequence
  Synthetically generated peptide
  VARIANT 3, 4, 5, 16: Xaa = Any Amino Acid
CCXXXEYCCNPACTGXCY

SEQ ID NO: 305 - protein, 18 aa, Artificial Sequence
  Synthetically generated peptide
  VARIANT 3, 4, 5, 17: Xaa = Any Amino Acid
CCXXXEYCCNPACTGCXY

SEQ ID NO: 306 - protein, 17 aa, Artificial Sequence
  Synthetically generated peptide
  VARIANT 3, 4, 6: Xaa = Any Amino Acid
CCXXEXYCCNPACTGCY

SEQ ID NO: 307 - protein, 18 aa, Artificial Sequence
  Synthetically generated peptide
  VARIANT 3, 4, 6, 7: Xaa = Any Amino Acid
CCXXEXXYCCNPACTGCY

SEQ ID NO: 308 - protein, 18 aa, Artificial Sequence
  Synthetically generated peptide
  VARIANT 3, 4, 6, 8: Xaa = Any Amino Acid
CCXXEXYXCCNPACTGCY

SEQ ID NO: 309 - protein, 18 aa, Artificial Sequence
  Synthetically generated peptide
  VARIANT 3, 4, 6, 10: Xaa = Any Amino Acid
CCXXEXYCCXNPACTGCY

SEQ ID NO: 310 - protein, 18 aa, Artificial Sequence
  Synthetically generated peptide
  VARIANT 3, 4, 6, 11: Xaa = Any Amino Acid
CCXXEXYCCNXPACTGCY

SEQ ID NO: 311 - protein, 18 aa, Artificial Sequence
  Synthetically generated peptide
  VARIANT 3, 4, 6, 12: Xaa = Any Amino Acid
CCXXEXYCCNPXACTGCY

SEQ ID NO: 312 - protein, 18 aa, Artificial Sequence
  Synthetically generated peptide
  VARIANT 3, 4, 6, 13: Xaa = Any Amino Acid
CCXXEXYCCNPAXCTGCY

SEQ ID NO: 313 - protein, 18 aa, Artificial Sequence
  Synthetically generated peptide
  VARIANT 3, 4, 6, 14: Xaa = Any Amino Acid
CCXXEXYCCNPACXTGCY

SEQ ID NO: 314 - protein, 18 aa, Artificial Sequence
  Synthetically generated peptide
  VARIANT 3, 4, 6, 15: Xaa = Any Amino Acid
CCXXEXYCCNPACTXGCY

SEQ ID NO: 315 - protein, 18 aa, Artificial Sequence
  Synthetically generated peptide
  VARIANT 3, 4, 6, 16: Xaa = Any Amino Acid
CCXXEXYCCNPACTGXCY

SEQ ID NO: 316 - protein, 18 aa, Artificial Sequence
  Synthetically generated peptide
  VARIANT 3, 4, 6, 17: Xaa = Any Amino Acid
CCXXEXYCCNPACTGCXY

SEQ ID NO: 317 - protein, 17 aa, Artificial Sequence
  Synthetically generated peptide
  VARIANT 3, 4, 7: Xaa = Any Amino Acid
CCXXEYXCCNPACTGCY

SEQ ID NO: 318 - protein, 18 aa, Artificial Sequence
  Synthetically generated peptide
  VARIANT 3, 4, 7, 8: Xaa = Any Amino Acid
CCXXEYXXCCNPACTGCY

SEQ ID NO: 319 - protein, 18 aa, Artificial Sequence
  Synthetically generated peptide
  VARIANT 3, 4, 7, 10: Xaa = Any Amino Acid
CCXXEYXCCXNPACTGCY

SEQ ID NO: 320 - protein, 18 aa, Artificial Sequence
  Synthetically generated peptide
  VARIANT 3, 4, 7, 11: Xaa = Any Amino Acid
CCXXEYXCCNXPACTGCY

SEQ ID NO: 321 - protein, 18 aa, Artificial Sequence
  Synthetically generated peptide
  VARIANT 3, 4, 7, 12: Xaa = Any Amino Acid
CCXXEYXCCNPXACTGCY

SEQ ID NO: 322 - protein, 18 aa, Artificial Sequence
  Synthetically generated peptide
  VARIANT 3, 4, 7, 13: Xaa = Any Amino Acid
CCXXEYXCCNPAXCTGCY

SEQ ID NO: 323 - protein, 18 aa, Artificial Sequence
  Synthetically generated peptide
  VARIANT 3, 4, 7, 14: Xaa = Any Amino Acid
CCXXEYXCCNPACXTGCY

SEQ ID NO: 324 - protein, 18 aa, Artificial Sequence
  Synthetically generated peptide
  VARIANT 3, 4, 7, 15: Xaa = Any Amino Acid
CCXXEYXCCNPACTXGCY

SEQ ID NO: 325 - protein, 18 aa, Artificial Sequence
  Synthetically generated peptide
  VARIANT 3, 4, 7, 16: Xaa = Any Amino Acid
CCXXEYXCCNPACTGXCY

SEQ ID NO: 326 - protein, 18 aa, Artificial Sequence
  Synthetically generated peptide
  VARIANT 3, 4, 7, 17: Xaa = Any Amino Acid
CCXXEYXCCNPACTGCXY

SEQ ID NO: 327 - protein, 17 aa, Artificial Sequence
  Synthetically generated peptide
  VARIANT 3, 4, 9: Xaa = Any Amino Acid
CCXXEYCCXNPACTGCY

SEQ ID NO: 328 - protein, 18 aa, Artificial Sequence
  Synthetically generated peptide
  VARIANT 3, 4, 9, 10: Xaa = Any Amino Acid
CCXXEYCCXXNPACTGCY

SEQ ID NO: 329 - protein, 18 aa, Artificial Sequence
  Synthetically generated peptide
  VARIANT 3, 4, 9, 11: Xaa = Any Amino Acid
CCXXEYCCXNXPACTGCY

SEQ ID NO: 330 - protein, 18 aa, Artificial Sequence
  Synthetically generated peptide
  VARIANT 3, 4, 9, 12: Xaa = Any Amino Acid
CCXXEYCCXNPXACTGCY

SEQ ID NO: 331 - protein, 18 aa, Artificial Sequence
  Synthetically generated peptide
  VARIANT 3, 4, 9, 13: Xaa = Any Amino Acid
CCXXEYCCXNPAXCTGCY

SEQ ID NO: 332 - protein, 18 aa, Artificial Sequence
  Synthetically generated peptide
  VARIANT 3, 4, 9, 14: Xaa = Any Amino Acid
CCXXEYCCXNPACXTGCY

SEQ ID NO: 333 - protein, 18 aa, Artificial Sequence
  Synthetically generated peptide
  VARIANT 3, 4, 9, 15: Xaa = Any Amino Acid
CCXXEYCCXNPACTXGCY

SEQ ID NO: 334 - protein, 18 aa, Artificial Sequence
  Synthetically generated peptide
  VARIANT 3, 4, 9, 16: Xaa = Any Amino Acid
CCXXEYCCXNPACTGXCY

SEQ ID NO: 335 - protein, 18 aa, Artificial Sequence
  Synthetically generated peptide
  VARIANT 3, 4, 9, 17: Xaa = Any Amino Acid
CCXXEYCCXNPACTGCXY

SEQ ID NO: 336 - protein, 17 aa, Artificial Sequence
  Synthetically generated peptide
  VARIANT 3, 4, 10: Xaa = Any Amino Acid
CCXXEYCCNXPACTGCY

SEQ ID NO: 337 - protein, 18 aa, Artificial Sequence
  Synthetically generated peptide
  VARIANT 3, 4, 10, 11: Xaa = Any Amino Acid
CCXXEYCCNXXPACTGCY

SEQ ID NO: 338 - protein, 18 aa, Artificial Sequence
  Synthetically generated peptide
  VARIANT 3, 4, 10, 12: Xaa = Any Amino Acid
CCXXEYCCNXPXACTGCY

SEQ ID NO: 339 - protein, 18 aa, Artificial Sequence
  Synthetically generated peptide
  VARIANT 3, 4, 10, 13: Xaa = Any Amino Acid
CCXXEYCCNXPAXCTGCY

SEQ ID NO: 340 - protein, 18 aa, Artificial Sequence
  Synthetically generated peptide
  VARIANT 3, 4, 10, 14: Xaa = Any Amino Acid
CCXXEYCCNXPACXTGCY

SEQ ID NO: 341 - protein, 18 aa, Artificial Sequence
  Synthetically generated peptide
  VARIANT 3, 4, 10, 15: Xaa = Any Amino Acid
CCXXEYCCNXPACTXGCY

SEQ ID NO: 342 - protein, 18 aa, Artificial Sequence
  Synthetically generated peptide
  VARIANT 3, 4, 10, 16: Xaa = Any Amino Acid
CCXXEYCCNXPACTGXCY

SEQ ID NO: 343 - protein, 18 aa, Artificial Sequence
  Synthetically generated peptide
  VARIANT 3, 4, 10, 17: Xaa = Any Amino Acid
CCXXEYCCNXPACTGCXY

SEQ ID NO: 344 - protein, 17 aa, Artificial Sequence
  Synthetically generated peptide
  VARIANT 3, 4, 11: Xaa = Any Amino Acid
CCXXEYCCNPXACTGCY

SEQ ID NO: 345 - protein, 18 aa, Artificial Sequence
  Synthetically generated peptide
  VARIANT 3, 4, 11, 12: Xaa = Any Amino Acid
CCXXEYCCNPXXACTGCY

SEQ ID NO: 346 - protein, 18 aa, Artificial Sequence
  Synthetically generated peptide
  VARIANT 3, 4, 11, 13: Xaa = Any Amino Acid
CCXXEYCCNPXAXCTGCY

SEQ ID NO: 347 - protein, 18 aa, Artificial Sequence
  Synthetically generated peptide
  VARIANT 3, 4, 11, 14: Xaa = Any Amino Acid
CCXXEYCCNPXACXTGCY

SEQ ID NO: 348 - protein, 18 aa, Artificial Sequence
  Synthetically generated peptide
  VARIANT 3, 4, 11, 15: Xaa = Any Amino Acid
CCXXEYCCNPXACTXGCY

SEQ ID NO: 349 - protein, 18 aa, Artificial Sequence
  Synthetically generated peptide
  VARIANT 3, 4, 11, 16: Xaa = Any Amino Acid
CCXXEYCCNPXACTGXCY

SEQ ID NO: 350 - protein, 18 aa, Artificial Sequence
  Synthetically generated peptide
  VARIANT 3, 4, 11, 17: Xaa = Any Amino Acid
CCXXEYCCNPXACTGCXY

SEQ ID NO: 351 - protein, 17 aa, Artificial Sequence
  Synthetically generated peptide
  VARIANT 3, 4, 12: Xaa = Any Amino Acid
CCXXEYCCNPAXCTGCY

SEQ ID NO: 352 - protein, 18 aa, Artificial Sequence
  Synthetically generated peptide
  VARIANT 3, 4, 12, 13: Xaa = Any Amino Acid
CCXXEYCCNPAXXCTGCY

SEQ ID NO: 353 - protein, 18 aa, Artificial Sequence
  Synthetically generated peptide
  VARIANT 3, 4, 12, 14: Xaa = Any Amino Acid
CCXXEYCCNPAXCXTGCY

SEQ ID NO: 354 - protein, 18 aa, Artificial Sequence
  Synthetically generated peptide
  VARIANT 3, 4, 12, 15: Xaa = Any Amino Acid
CCXXEYCCNPAXCTXGCY

SEQ ID NO: 355 - protein, 18 aa, Artificial Sequence
  Synthetically generated peptide
  VARIANT 3, 4, 12, 16: Xaa = Any Amino Acid
CCXXEYCCNPAXCTGXCY

SEQ ID NO: 356 - protein, 18 aa, Artificial Sequence
  Synthetically generated peptide
  VARIANT 3, 4, 12, 17: Xaa = Any Amino Acid
CCXXEYCCNPAXCTGCXY

SEQ ID NO: 357 - protein, 17 aa, Artificial Sequence
  Synthetically generated peptide
  VARIANT 3, 4, 13: Xaa = Any Amino Acid
CCXXEYCCNPACXTGCY

SEQ ID NO: 358 - protein, 18 aa, Artificial Sequence
  Synthetically generated peptide
  VARIANT 3, 4, 13, 14: Xaa = Any Amino Acid
CCXXEYCCNPACXXTGCY

SEQ ID NO: 359 - protein, 18 aa, Artificial Sequence
  Synthetically generated peptide
  VARIANT 3, 4, 13, 15: Xaa = Any Amino Acid
CCXXEYCCNPACXTXGCY

SEQ ID NO: 360 - protein, 18 aa, Artificial Sequence
  Synthetically generated peptide
  VARIANT 3, 4, 13, 16: Xaa = Any Amino Acid
CCXXEYCCNPACXTGXCY

SEQ ID NO: 361 - protein, 18 aa, Artificial Sequence
  Synthetically generated peptide
  VARIANT 3, 4, 13, 17: Xaa = Any Amino Acid
CCXXEYCCNPACXTGCXY

SEQ ID NO: 362 - protein, 17 aa, Artificial Sequence
  Synthetically generated peptide
  VARIANT 3, 4, 14: Xaa = Any Amino Acid
CCXXEYCCNPACTXGCY

SEQ ID NO: 363 - protein, 18 aa, Artificial Sequence
  Synthetically generated peptide
  VARIANT 3, 4, 14, 15: Xaa = Any Amino Acid
CCXXEYCCNPACTXXGCY

SEQ ID NO: 364 - protein, 18 aa, Artificial Sequence
  Synthetically generated peptide
  VARIANT 3, 4, 14, 16: Xaa = Any Amino Acid
CCXXEYCCNPACTXGXCY

SEQ ID NO: 365 - protein, 18 aa, Artificial Sequence
  Synthetically generated peptide
  VARIANT 3, 4, 14, 17: Xaa = Any Amino Acid
CCXXEYCCNPACTXGCXY

SEQ ID NO: 366 - protein, 17 aa, Artificial Sequence
  Synthetically generated peptide
  VARIANT 3, 4, 15: Xaa = Any Amino Acid
CCXXEYCCNPACTGXCY

SEQ ID NO: 367 - protein, 18 aa, Artificial Sequence
  Synthetically generated peptide
  VARIANT 3, 4, 15, 16: Xaa = Any Amino Acid
CCXXEYCCNPACTGXXCY

SEQ ID NO: 368 - protein, 18 aa, Artificial Sequence
  Synthetically generated peptide
  VARIANT 3, 4, 15, 17: Xaa = Any Amino Acid
CCXXEYCCNPACTGXCXY

SEQ ID NO: 369 - protein, 17 aa, Artificial Sequence
  Synthetically generated peptide
  VARIANT 3, 4, 16: Xaa = Any Amino Acid
CCXXEYCCNPACTGCXY

SEQ ID NO: 370 - protein, 18 aa, Artificial Sequence
  Synthetically generated peptide
  VARIANT 3, 4, 16, 17: Xaa = Any Amino Acid
CCXXEYCCNPACTGCXXY

SEQ ID NO: 371 - protein, 16 aa, Artificial Sequence
  Synthetically generated peptide
  VARIANT 3, 5,: Xaa = Any Amino Acid
CCXEXYCCNPACTGCY

SEQ ID NO: 372 - protein, 17 aa, Artificial Sequence
  Synthetically generated peptide
  VARIANT 3, 5, 6: Xaa = Any Amino Acid
CCXEXXYCCNPACTGCY

SEQ ID NO: 373 - protein, 18 aa, Artificial Sequence
  Synthetically generated peptide
  VARIANT 3, 5, 6, 7: Xaa = Any Amino Acid
CCXEXXXYCCNPACTGCY

SEQ ID NO: 374 - protein, 18 aa, Artificial Sequence
  Synthetically generated peptide
  VARIANT 3, 5, 6, 8: Xaa = Any Amino Acid
CCXEXXYXCCNPACTGCY

SEQ ID NO: 375 - protein, 18 aa, Artificial Sequence
  Synthetically generated peptide
  VARIANT 3, 5, 6, 10: Xaa = Any Amino Acid
CCXEXXYCCXNPACTGCY

SEQ ID NO: 376 - protein, 18 aa, Artificial Sequence
  Synthetically generated peptide
  VARIANT 3, 5, 6, 11: Xaa = Any Amino Acid
CCXEXXYCCNXPACTGCY

SEQ ID NO: 377 - protein, 18 aa, Artificial Sequence
  Synthetically generated peptide
  VARIANT 3, 5, 6, 12: Xaa = Any Amino Acid
CCXEXXYCCNPXACTGCY

SEQ ID NO: 378 - protein, 18 aa, Artificial Sequence
  Synthetically generated peptide
  VARIANT 3, 5, 6, 13: Xaa = Any Amino Acid
CCXEXXYCCNPAXCTGCY

SEQ ID NO: 379 - protein, 18 aa, Artificial Sequence
  Synthetically generated peptide
  VARIANT 3, 5, 6, 14: Xaa = Any Amino Acid
CCXEXXYCCNPACXTGCY

SEQ ID NO: 380 - protein, 18 aa, Artificial Sequence
  Synthetically generated peptide
  VARIANT 3, 5, 6, 15: Xaa = Any Amino Acid
CCXEXXYCCNPACTXGCY

SEQ ID NO: 381 - protein, 18 aa, Artificial Sequence
  Synthetically generated peptide
  VARIANT 3, 5, 6, 16: Xaa = Any Amino Acid
CCXEXXYCCNPACTGXCY

SEQ ID NO: 382 - protein, 18 aa, Artificial Sequence
  Synthetically generated peptide
  VARIANT 3, 5, 6, 17: Xaa = Any Amino Acid
CCXEXXYCCNPACTGCXY

SEQ ID NO: 383 - protein, 17 aa, Artificial Sequence
  Synthetically generated peptide
  VARIANT 3, 5, 7: Xaa = Any Amino Acid
CCXEXYXCCNPACTGCY

SEQ ID NO: 384 - protein, 18 aa, Artificial Sequence
  Synthetically generated peptide
  VARIANT 3, 5, 7, 8: Xaa = Any Amino Acid
CCXEXYXXCCNPACTGCY

SEQ ID NO: 385 - protein, 18 aa, Artificial Sequence
  Synthetically generated peptide
  VARIANT 3, 5, 7, 10: Xaa = Any Amino Acid
CCXEXYXCCXNPACTGCY

SEQ ID NO: 386 - protein, 18 aa, Artificial Sequence
  Synthetically generated peptide
  VARIANT 3, 5, 7,, 11: Xaa = Any Amino Acid
CCXEXYXCCNXPACTGCY

SEQ ID NO: 387 - protein, 18 aa, Artificial Sequence
  Synthetically generated peptide
  VARIANT 3, 5, 7, 12: Xaa = Any Amino Acid
CCXEXYXCCNPXACTGCY

SEQ ID NO: 388 - protein, 18 aa, Artificial Sequence
  Synthetically generated peptide
  VARIANT 3, 5, 7,, 13: Xaa = Any Amino Acid
CCXEXYXCCNPAXCTGCY

SEQ ID NO: 389 - protein, 18 aa, Artificial Sequence
  Synthetically generated peptide
  VARIANT 3, 5, 7,, 14: Xaa = Any Amino Acid
CCXEXYXCCNPACXTGCY

SEQ ID NO: 390 - protein, 18 aa, Artificial Sequence
  Synthetically generated peptide
  VARIANT 3, 5, 7, 15: Xaa = Any Amino Acid
CCXEXYXCCNPACTXGCY

SEQ ID NO: 391 - protein, 18 aa, Artificial Sequence
  Synthetically generated peptide
  VARIANT 3, 5, 7, 16: Xaa = Any Amino Acid
CCXEXYXCCNPACTGXCY

SEQ ID NO: 392 - protein, 18 aa, Artificial Sequence
  Synthetically generated peptide
  VARIANT 3, 5, 7, 17: Xaa = Any Amino Acid
CCXEXYXCCNPACTGCXY

SEQ ID NO: 393 - protein, 17 aa, Artificial Sequence
  Synthetically generated peptide
  VARIANT 3, 5, 9: Xaa = Any Amino Acid
CCXEXYCCXNPACTGCY

SEQ ID NO: 394 - protein, 18 aa, Artificial Sequence
  Synthetically generated peptide
  VARIANT 3, 5, 9, 10: Xaa = Any Amino Acid
CCXEXYCCXXNPACTGCY

SEQ ID NO: 395 - protein, 18 aa, Artificial Sequence
  Synthetically generated peptide
  VARIANT 3, 5, 9, 11: Xaa = Any Amino Acid
CCXEXYCCXNXPACTGCY

SEQ ID NO: 396 - protein, 18 aa, Artificial Sequence
  Synthetically generated peptide
  VARIANT 3, 5, 9, 12: Xaa = Any Amino Acid
CCXEXYCCXNPXACTGCY

SEQ ID NO: 397 - protein, 18 aa, Artificial Sequence
  Synthetically generated peptide
  VARIANT 3, 5, 9, 13: Xaa = Any Amino Acid
CCXEXYCCXNPAXCTGCY

SEQ ID NO: 398 - protein, 18 aa, Artificial Sequence
  Synthetically generated peptide
  VARIANT 3, 5, 9, 14: Xaa = Any Amino Acid
CCXEXYCCXNPACXTGCY

SEQ ID NO: 399 - protein, 18 aa, Artificial Sequence
  Synthetically generated peptide
  VARIANT 3, 5, 9, 15: Xaa = Any Amino Acid
CCXEXYCCXNPACTXGCY

SEQ ID NO: 400 - protein, 18 aa, Artificial Sequence
  Synthetically generated peptide
  VARIANT 3, 5, 9, 16: Xaa = Any Amino Acid
CCXEXYCCXNPACTGXCY

SEQ ID NO: 401 - protein, 18 aa, Artificial Sequence
  Synthetically generated peptide
  VARIANT 3, 5, 9, 17: Xaa = Any Amino Acid
CCXEXYCCXNPACTGCXY

SEQ ID NO: 402 - protein, 17 aa, Artificial Sequence
  Synthetically generated peptide
  VARIANT 3, 5, 10: Xaa = Any Amino Acid
CCXEXYCCNXPACTGCY

SEQ ID NO: 403 - protein, 18 aa, Artificial Sequence
  Synthetically generated peptide
  VARIANT 3, 5, 10, 11: Xaa = Any Amino Acid
CCXEXYCCNXXPACTGCY

SEQ ID NO: 404 - protein, 18 aa, Artificial Sequence
  Synthetically generated peptide
  VARIANT 3, 5, 10, 12: Xaa = Any Amino Acid
CCXEXYCCNXPXACTGCY

SEQ ID NO: 405 - protein, 18 aa, Artificial Sequence
  Synthetically generated peptide
  VARIANT 3, 5, 10, 13: Xaa = Any Amino Acid
CCXEXYCCNXPAXCTGCY

SEQ ID NO: 406 - protein, 18 aa, Artificial Sequence
  Synthetically generated peptide
  VARIANT 3, 5, 10, 14: Xaa = Any Amino Acid
CCXEXYCCNXPACXTGCY

SEQ ID NO: 407 - protein, 18 aa, Artificial Sequence
  Synthetically generated peptide
  VARIANT 3, 5, 10, 15: Xaa = Any Amino Acid
CCXEXYCCNXPACTXGCY

SEQ ID NO: 408 - protein, 18 aa, Artificial Sequence
  Synthetically generated peptide
  VARIANT 3, 5, 10, 16: Xaa = Any Amino Acid
CCXEXYCCNXPACTGXCY

SEQ ID NO: 409 - protein, 18 aa, Artificial Sequence
  Synthetically generated peptide
  VARIANT 3, 5, 10, 17: Xaa = Any Amino Acid
CCXEXYCCNXPACTGCXY

SEQ ID NO: 410 - protein, 17 aa, Artificial Sequence
  Synthetically generated peptide
  VARIANT 3, 5, 11: Xaa = Any Amino Acid
CCXEXYCCNPXACTGCY

SEQ ID NO: 411 - protein, 18 aa, Artificial Sequence
  Synthetically generated peptide
  VARIANT 3, 5, 11, 12: Xaa = Any Amino Acid
CCXEXYCCNPXXACTGCY

SEQ ID NO: 412 - protein, 18 aa, Artificial Sequence
  Synthetically generated peptide
  VARIANT 3, 5, 11, 13: Xaa = Any Amino Acid
CCXEXYCCNPXAXCTGCY

SEQ ID NO: 413 - protein, 18 aa, Artificial Sequence
  Synthetically generated peptide
  VARIANT 3, 5, 11, 14: Xaa = Any Amino Acid
CCXEXYCCNPXACXTGCY

SEQ ID NO: 414 - protein, 18 aa, Artificial Sequence
  Synthetically generated peptide
  VARIANT 3, 5, 11, 15: Xaa = Any Amino Acid
CCXEXYCCNPXACTXGCY

SEQ ID NO: 415 - protein, 18 aa, Artificial Sequence
  Synthetically generated peptide
  VARIANT 3, 5, 11, 16: Xaa = Any Amino Acid
CCXEXYCCNPXACTGXCY

SEQ ID NO: 416 - protein, 18 aa, Artificial Sequence
  Synthetically generated peptide
  VARIANT 3, 5, 11, 17: Xaa = Any Amino Acid
CCXEXYCCNPXACTGCXY

SEQ ID NO: 417 - protein, 17 aa, Artificial Sequence
  Synthetically generated peptide
  VARIANT 3, 5, 12: Xaa = Any Amino Acid
CCXEXYCCNPAXCTGCY

SEQ ID NO: 418 - protein, 18 aa, Artificial Sequence
  Synthetically generated peptide
  VARIANT 3, 5, 12, 13: Xaa = Any Amino Acid
CCXEXYCCNPAXXCTGCY

SEQ ID NO: 419 - protein, 18 aa, Artificial Sequence
  Synthetically generated peptide
  VARIANT 3, 5, 12, 14: Xaa = Any Amino Acid
CCXEXYCCNPAXCXTGCY

SEQ ID NO: 420 - protein, 18 aa, Artificial Sequence
  Synthetically generated peptide
  VARIANT 3, 5, 12, 15: Xaa = Any Amino Acid
CCXEXYCCNPAXCTXGCY

SEQ ID NO: 421 - protein, 18 aa, Artificial Sequence
  Synthetically generated peptide
  VARIANT 3, 5, 12, 16: Xaa = Any Amino Acid
CCXEXYCCNPAXCTGXCY

SEQ ID NO: 422 - protein, 18 aa, Artificial Sequence
  Synthetically generated peptide
  VARIANT 3, 5, 12, 17: Xaa = Any Amino Acid
CCXEXYCCNPAXCTGCXY

SEQ ID NO: 423 - protein, 17 aa, Artificial Sequence
  Synthetically generated peptide
  VARIANT 3, 5, 13: Xaa = Any Amino Acid
CCXEXYCCNPACXTGCY

SEQ ID NO: 424 - protein, 18 aa, Artificial Sequence
  Synthetically generated peptide
  VARIANT 3, 5, 13, 14: Xaa = Any Amino Acid
CCXEXYCCNPACXXTGCY

SEQ ID NO: 425 - protein, 18 aa, Artificial Sequence
  Synthetically generated peptide
  VARIANT 3, 5, 13, 15: Xaa = Any Amino Acid
CCXEXYCCNPACXTXGCY

SEQ ID NO: 426 - protein, 18 aa, Artificial Sequence
  Synthetically generated peptide
  VARIANT 3, 5, 13, 16: Xaa = Any Amino Acid
CCXEXYCCNPACXTGXCY

SEQ ID NO: 427 - protein, 18 aa, Artificial Sequence
  Synthetically generated peptide
  VARIANT 3, 5, 13, 17: Xaa = Any Amino Acid
CCXEXYCCNPACXTGCXY

SEQ ID NO: 428 - protein, 17 aa, Artificial Sequence
  Synthetically generated peptide
  VARIANT 3, 5, 14: Xaa = Any Amino Acid
CCXEXYCCNPACTXGCY

SEQ ID NO: 429 - protein, 18 aa, Artificial Sequence
  Synthetically generated peptide
  VARIANT 3, 5, 14, 15: Xaa = Any Amino Acid
CCXEXYCCNPACTXXGCY

SEQ ID NO: 430 - protein, 18 aa, Artificial Sequence
  Synthetically generated peptide
  VARIANT 3, 5, 14, 16: Xaa = Any Amino Acid
CCXEXYCCNPACTXGXCY

SEQ ID NO: 431 - protein, 18 aa, Artificial Sequence
  Synthetically generated peptide
  VARIANT 3, 5, 14, 17: Xaa = Any Amino Acid
CCXEXYCCNPACTXGCXY

SEQ ID NO: 432 - protein, 17 aa, Artificial Sequence
  Synthetically generated peptide
  VARIANT 3, 5, 15: Xaa = Any Amino Acid
CCXEXYCCNPACTGXCY

SEQ ID NO: 433 - protein, 18 aa, Artificial Sequence
  Synthetically generated peptide
  VARIANT 3, 5, 15, 16: Xaa = Any Amino Acid
CCXEXYCCNPACTGXXCY

SEQ ID NO: 434 - protein, 18 aa, Artificial Sequence
  Synthetically generated peptide
  VARIANT 3, 5, 15, 17: Xaa = Any Amino Acid
CCXEXYCCNPACTGXCXY

SEQ ID NO: 435 - protein, 17 aa, Artificial Sequence
  Synthetically generated peptide
  VARIANT 3, 5, 16: Xaa = Any Amino Acid
CCXEXYCCNPACTGCXY

SEQ ID NO: 436 - protein, 18 aa, Artificial Sequence
  Synthetically generated peptide
  VARIANT 3, 5, 16, 17: Xaa = Any Amino Acid
CCXEXYCCNPACTGCXXY

SEQ ID NO: 437 - protein, 16 aa, Artificial Sequence
  Synthetically generated peptide
  VARIANT 3, 6: Xaa = Any Amino Acid
CCXEYXCCNPACTGCY

SEQ ID NO: 438 - protein, 17 aa, Artificial Sequence
  Synthetically generated peptide
  VARIANT 3, 6, 7: Xaa = Any Amino Acid
CCXEYXXCCNPACTGCY

SEQ ID NO: 439 - protein, 18 aa, Artificial Sequence
  Synthetically generated peptide
  VARIANT 3, 6, 7, 8: Xaa = Any Amino Acid
CCXEYXXXCCNPACTGCY

SEQ ID NO: 440 - protein, 18 aa, Artificial Sequence
  Synthetically generated peptide
  VARIANT 3, 6, 7, 10: Xaa = Any Amino Acid
CCXEYXXCCXNPACTGCY

SEQ ID NO: 441 - protein, 18 aa, Artificial Sequence
  Synthetically generated peptide
  VARIANT 3, 6, 7, 11: Xaa = Any Amino Acid
CCXEYXXCCNXPACTGCY

SEQ ID NO: 442 - protein, 18 aa, Artificial Sequence
  Synthetically generated peptide
  VARIANT 3, 6, 7, 12: Xaa = Any Amino Acid
CCXEYXXCCNPXACTGCY

SEQ ID NO: 443 - protein, 18 aa, Artificial Sequence
  Synthetically generated peptide
  VARIANT 3, 6, 7, 13: Xaa = Any Amino Acid
CCXEYXXCCNPAXCTGCY

SEQ ID NO: 444 - protein, 18 aa, Artificial Sequence
  Synthetically generated peptide
  VARIANT 3, 6, 7, 14: Xaa = Any Amino Acid
CCXEYXXCCNPACXTGCY

SEQ ID NO: 445 - protein, 18 aa, Artificial Sequence
  Synthetically generated peptide
  VARIANT 3, 6, 7, 15: Xaa = Any Amino Acid
CCXEYXXCCNPACTXGCY

SEQ ID NO: 446 - protein, 18 aa, Artificial Sequence
  Synthetically generated peptide
  VARIANT 3, 6, 7, 16: Xaa = Any Amino Acid
CCXEYXXCCNPACTGXCY

SEQ ID NO: 447 - protein, 18 aa, Artificial Sequence
  Synthetically generated peptide
  VARIANT 3, 6, 7, 17: Xaa = Any Amino Acid
CCXEYXXCCNPACTGCXY

SEQ ID NO: 448 - protein, 17 aa, Artificial Sequence
  Synthetically generated peptide
  VARIANT 3, 6, 9: Xaa = Any Amino Acid
CCXEYXCCXNPACTGCY

SEQ ID NO: 449 - protein, 18 aa, Artificial Sequence
  Synthetically generated peptide
  VARIANT 3, 6, 9, 10: Xaa = Any Amino Acid
CCXEYXCCXXNPACTGCY

SEQ ID NO: 450 - protein, 18 aa, Artificial Sequence
  Synthetically generated peptide
  VARIANT 3, 6, 9, 11: Xaa = Any Amino Acid
CCXEYXCCXNXPACTGCY

SEQ ID NO: 451 - protein, 18 aa, Artificial Sequence
  Synthetically generated peptide
  VARIANT 3, 6, 9, 12: Xaa = Any Amino Acid
CCXEYXCCXNPXACTGCY

SEQ ID NO: 452 - protein, 18 aa, Artificial Sequence
  Synthetically generated peptide
  VARIANT 3, 6, 9, 13: Xaa = Any Amino Acid
CCXEYXCCXNPAXCTGCY

SEQ ID NO: 453 - protein, 18 aa, Artificial Sequence
  Synthetically generated peptide
  VARIANT 3, 6, 9, 14: Xaa = Any Amino Acid
CCXEYXCCXNPACXTGCY

SEQ ID NO: 454 - protein, 18 aa, Artificial Sequence
  Synthetically generated peptide
  VARIANT 3, 6, 9, 15: Xaa = Any Amino Acid
CCXEYXCCXNPACTXGCY

SEQ ID NO: 455 - protein, 18 aa, Artificial Sequence
  Synthetically generated peptide
  VARIANT 3, 6, 9, 16: Xaa = Any Amino Acid
CCXEYXCCXNPACTGXCY

SEQ ID NO: 456 - protein, 18 aa, Artificial Sequence
  Synthetically generated peptide
  VARIANT 3, 6, 9, 17: Xaa = Any Amino Acid
CCXEYXCCXNPACTGCXY

SEQ ID NO: 457 - protein, 17 aa, Artificial Sequence
  Synthetically generated peptide
  VARIANT 3, 6, 10: Xaa = Any Amino Acid
CCXEYXCCNXPACTGCY

SEQ ID NO: 458 - protein, 18 aa, Artificial Sequence
  Synthetically generated peptide
  VARIANT 3, 6, 10, 11: Xaa = Any Amino Acid
CCXEYXCCNXXPACTGCY

SEQ ID NO: 459 - protein, 18 aa, Artificial Sequence
  Synthetically generated peptide
  VARIANT 3, 6, 10, 12: Xaa = Any Amino Acid
CCXEYXCCNXPXACTGCY

SEQ ID NO: 460 - protein, 18 aa, Artificial Sequence
  Synthetically generated peptide
  VARIANT 3, 6, 10, 13: Xaa = Any Amino Acid
CCXEYXCCNXPAXCTGCY

SEQ ID NO: 461 - protein, 18 aa, Artificial Sequence
  Synthetically generated peptide
  VARIANT 3, 6, 10, 14: Xaa = Any Amino Acid
CCXEYXCCNXPACXTGCY

SEQ ID NO: 462 - protein, 18 aa, Artificial Sequence
  Synthetically generated peptide
  VARIANT 3, 6, 10, 15: Xaa = Any Amino Acid
CCXEYXCCNXPACTXGCY

SEQ ID NO: 463 - protein, 18 aa, Artificial Sequence
  Synthetically generated peptide
  VARIANT 3, 6, 10, 16: Xaa = Any Amino Acid
CCXEYXCCNXPACTGXCY

SEQ ID NO: 464 - protein, 18 aa, Artificial Sequence
  Synthetically generated peptide
  VARIANT 3, 6, 10, 17: Xaa = Any Amino Acid
CCXEYXCCNXPACTGCXY

SEQ ID NO: 465 - protein, 17 aa, Artificial Sequence
  Synthetically generated peptide
  VARIANT 3, 6, 11: Xaa = Any Amino Acid
CCXEYXCCNPXACTGCY

SEQ ID NO: 466 - protein, 18 aa, Artificial Sequence
  Synthetically generated peptide
  VARIANT 3, 6, 11, 12: Xaa = Any Amino Acid
CCXEYXCCNPXXACTGCY

SEQ ID NO: 467 - protein, 18 aa, Artificial Sequence
  Synthetically generated peptide
  VARIANT 3, 6, 11, 13: Xaa = Any Amino Acid
CCXEYXCCNPXAXCTGCY

SEQ ID NO: 468 - protein, 18 aa, Artificial Sequence
  Synthetically generated peptide
  VARIANT 3, 6, 11, 14: Xaa = Any Amino Acid
CCXEYXCCNPXACXTGCY

SEQ ID NO: 469 - protein, 18 aa, Artificial Sequence
  Synthetically generated peptide
  VARIANT 3, 6, 11, 15: Xaa = Any Amino Acid
CCXEYXCCNPXACTXGCY

SEQ ID NO: 470 - protein, 18 aa, Artificial Sequence
  Synthetically generated peptide
  VARIANT 3, 6, 11, 16: Xaa = Any Amino Acid
CCXEYXCCNPXACTGXCY

SEQ ID NO: 471 - protein, 18 aa, Artificial Sequence
  Synthetically generated peptide
  VARIANT 3, 6, 11, 17: Xaa = Any Amino Acid
CCXEYXCCNPXACTGCXY

SEQ ID NO: 472 - protein, 17 aa, Artificial Sequence
  Synthetically generated peptide
  VARIANT 3, 6, 12: Xaa = Any Amino Acid
CCXEYXCCNPAXCTGCY

SEQ ID NO: 473 - protein, 18 aa, Artificial Sequence
  Synthetically generated peptide
  VARIANT 3, 6, 12, 13: Xaa = Any Amino Acid
CCXEYXCCNPAXXCTGCY

SEQ ID NO: 474 - protein, 18 aa, Artificial Sequence
  Synthetically generated peptide
  VARIANT 3, 6, 12, 14: Xaa = Any Amino Acid
CCXEYXCCNPAXCXTGCY

SEQ ID NO: 475 - protein, 18 aa, Artificial Sequence
  Synthetically generated peptide
  VARIANT 3, 6, 12, 15: Xaa = Any Amino Acid
CCXEYXCCNPAXCTXGCY

SEQ ID NO: 476 - protein, 18 aa, Artificial Sequence
  Synthetically generated peptide
  VARIANT 3, 6, 12, 16: Xaa = Any Amino Acid
CCXEYXCCNPAXCTGXCY

SEQ ID NO: 477 - protein, 18 aa, Artificial Sequence
  Synthetically generated peptide
  VARIANT 3, 6, 12, 17: Xaa = Any Amino Acid
CCXEYXCCNPAXCTGCXY

SEQ ID NO: 478 - protein, 17 aa, Artificial Sequence
  Synthetically generated peptide
  VARIANT 3, 6, 13: Xaa = Any Amino Acid
CCXEYXCCNPACXTGCY

SEQ ID NO: 479 - protein, 18 aa, Artificial Sequence
  Synthetically generated peptide
  VARIANT 3, 6, 13, 14: Xaa = Any Amino Acid
CCXEYXCCNPACXXTGCY

SEQ ID NO: 480 - protein, 18 aa, Artificial Sequence
  Synthetically generated peptide
  VARIANT 3, 6, 13, 15: Xaa = Any Amino Acid
CCXEYXCCNPACXTXGCY

SEQ ID NO: 481 - protein, 18 aa, Artificial Sequence
  Synthetically generated peptide
  VARIANT 3, 6, 13, 16: Xaa = Any Amino Acid
CCXEYXCCNPACXTGXCY

SEQ ID NO: 482 - protein, 18 aa, Artificial Sequence
  Synthetically generated peptide
  VARIANT 3, 6, 13, 17: Xaa = Any Amino Acid
CCXEYXCCNPACXTGCXY

SEQ ID NO: 483 - protein, 17 aa, Artificial Sequence
  Synthetically generated peptide
  VARIANT 3, 6, 14: Xaa = Any Amino Acid
CCXEYXCCNPACTXGCY

SEQ ID NO: 484 - protein, 18 aa, Artificial Sequence
  Synthetically generated peptide
  VARIANT 3, 6, 14, 15: Xaa = Any Amino Acid
CCXEYXCCNPACTXXGCY

SEQ ID NO: 485 - protein, 18 aa, Artificial Sequence
  Synthetically generated peptide
  VARIANT 3, 6, 14, 16: Xaa = Any Amino Acid
CCXEYXCCNPACTXGXCY

SEQ ID NO: 486 - protein, 18 aa, Artificial Sequence
  Synthetically generated peptide
  VARIANT 3, 6, 14, 17: Xaa = Any Amino Acid
CCXEYXCCNPACTXGCXY

SEQ ID NO: 487 - protein, 17 aa, Artificial Sequence
  Synthetically generated peptide
  VARIANT 3, 6, 15: Xaa = Any Amino Acid
CCXEYXCCNPACTGXCY

SEQ ID NO: 488 - protein, 18 aa, Artificial Sequence
  Synthetically generated peptide
  VARIANT 3, 6, 15, 16: Xaa = Any Amino Acid
CCXEYXCCNPACTGXXCY

SEQ ID NO: 489 - protein, 18 aa, Artificial Sequence
  Synthetically generated peptide
  VARIANT 3, 6, 15, 17: Xaa = Any Amino Acid
CCXEYXCCNPACTGXCXY

SEQ ID NO: 490 - protein, 17 aa, Artificial Sequence
  Synthetically generated peptide
  VARIANT 3, 6, 16: Xaa = Any Amino Acid
CCXEYXCCNPACTGCXY

SEQ ID NO: 491 - protein, 18 aa, Artificial Sequence
  Synthetically generated peptide
  VARIANT 3, 6, 16, 17: Xaa = Any Amino Acid
CCXEYXCCNPACTGCXXY

SEQ ID NO: 492 - protein, 16 aa, Artificial Sequence
  Synthetically generated peptide
  VARIANT 3, 8: Xaa = Any Amino Acid
CCXEYCCXNPACTGCY

SEQ ID NO: 493 - protein, 17 aa, Artificial Sequence
  Synthetically generated peptide
  VARIANT 3, 8, 9: Xaa = Any Amino Acid
CCXEYCCXXNPACTGCY

SEQ ID NO: 494 - protein, 18 aa, Artificial Sequence
  Synthetically generated peptide
  VARIANT 3, 8, 9, 10: Xaa = Any Amino Acid
CCXEYCCXXXNPACTGCY

SEQ ID NO: 495 - protein, 18 aa, Artificial Sequence
  Synthetically generated peptide
  VARIANT 3, 8, 9, 11: Xaa = Any Amino Acid
CCXEYCCXXNXPACTGCY

SEQ ID NO: 496 - protein, 18 aa, Artificial Sequence
  Synthetically generated peptide
  VARIANT 3, 8, 9, 12: Xaa = Any Amino Acid
CCXEYCCXXNPXACTGCY

SEQ ID NO: 497 - protein, 18 aa, Artificial Sequence
  Synthetically generated peptide
  VARIANT 3, 8, 9, 13: Xaa = Any Amino Acid
CCXEYCCXXNPAXCTGCY

SEQ ID NO: 498 - protein, 18 aa, Artificial Sequence
  Synthetically generated peptide
  VARIANT 3, 8, 9, 14: Xaa = Any Amino Acid
CCXEYCCXXNPACXTGCY

SEQ ID NO: 499 - protein, 18 aa, Artificial Sequence
  Synthetically generated peptide
  VARIANT 3, 8, 9, 15: Xaa = Any Amino Acid
CCXEYCCXXNPACTXGCY

SEQ ID NO: 500 - protein, 18 aa, Artificial Sequence
  Synthetically generated peptide
  VARIANT 3, 8, 9, 16: Xaa = Any Amino Acid
CCXEYCCXXNPACTGXCY

SEQ ID NO: 501 - protein, 18 aa, Artificial Sequence
  Synthetically generated peptide
  VARIANT 3, 8, 9, 17: Xaa = Any Amino Acid
CCXEYCCXXNPACTGCXY

SEQ ID NO: 502 - protein, 17 aa, Artificial Sequence
  Synthetically generated peptide
  VARIANT 3, 8, 10: Xaa = Any Amino Acid
CCXEYCCXNXPACTGCY

SEQ ID NO: 503 - protein, 18 aa, Artificial Sequence
  Synthetically generated peptide
  VARIANT 3, 8, 10, 11: Xaa = Any Amino Acid
CCXEYCCXNXXPACTGCY

SEQ ID NO: 504 - protein, 18 aa, Artificial Sequence
  Synthetically generated peptide
  VARIANT 3, 8, 10, 12: Xaa = Any Amino Acid
CCXEYCCXNXPXACTGCY

SEQ ID NO: 505 - protein, 18 aa, Artificial Sequence
  Synthetically generated peptide
  VARIANT 3, 8, 10, 13: Xaa = Any Amino Acid
CCXEYCCXNXPAXCTGCY

SEQ ID NO: 506 - protein, 18 aa, Artificial Sequence
  Synthetically generated peptide
  VARIANT 3, 8, 10, 14: Xaa = Any Amino Acid
CCXEYCCXNXPACXTGCY

SEQ ID NO: 507 - protein, 18 aa, Artificial Sequence
  Synthetically generated peptide
  VARIANT 3, 8, 10, 15: Xaa = Any Amino Acid
CCXEYCCXNXPACTXGCY

SEQ ID NO: 508 - protein, 18 aa, Artificial Sequence
  Synthetically generated peptide
  VARIANT 3, 8, 10, 16: Xaa = Any Amino Acid
CCXEYCCXNXPACTGXCY

SEQ ID NO: 509 - protein, 18 aa, Artificial Sequence
  Synthetically generated peptide
  VARIANT 3, 8, 10, 17: Xaa = Any Amino Acid
CCXEYCCXNXPACTGCXY

SEQ ID NO: 510 - protein, 17 aa, Artificial Sequence
  Synthetically generated peptide
  VARIANT 3, 8, 11: Xaa = Any Amino Acid
CCXEYCCXNPXACTGCY

SEQ ID NO: 511 - protein, 18 aa, Artificial Sequence
  Synthetically generated peptide
  VARIANT 3, 8, 11, 12: Xaa = Any Amino Acid
CCXEYCCXNPXXACTGCY

SEQ ID NO: 512 - protein, 18 aa, Artificial Sequence
  Synthetically generated peptide
  VARIANT 3, 8, 11, 13: Xaa = Any Amino Acid
CCXEYCCXNPXAXCTGCY

SEQ ID NO: 513 - protein, 18 aa, Artificial Sequence
  Synthetically generated peptide
  VARIANT 3, 8, 11, 14: Xaa = Any Amino Acid
CCXEYCCXNPXACXTGCY

SEQ ID NO: 514 - protein, 18 aa, Artificial Sequence
  Synthetically generated peptide
  VARIANT 3, 8, 11, 15: Xaa = Any Amino Acid
CCXEYCCXNPXACTXGCY

SEQ ID NO: 515 - protein, 18 aa, Artificial Sequence
  Synthetically generated peptide
  VARIANT 3, 8, 11, 16: Xaa = Any Amino Acid
CCXEYCCXNPXACTGXCY

SEQ ID NO: 516 - protein, 18 aa, Artificial Sequence
  Synthetically generated peptide
  VARIANT 3, 8, 11, 17: Xaa = Any Amino Acid
CCXEYCCXNPXACTGCXY

SEQ ID NO: 517 - protein, 17 aa, Artificial Sequence
  Synthetically generated peptide
  VARIANT 3, 8, 12: Xaa = Any Amino Acid
CCXEYCCXNPAXCTGCY

SEQ ID NO: 518 - protein, 18 aa, Artificial Sequence
  Synthetically generated peptide
  VARIANT 3, 8, 12, 13: Xaa = Any Amino Acid
CCXEYCCXNPAXXCTGCY

SEQ ID NO: 519 - protein, 18 aa, Artificial Sequence
  Synthetically generated peptide
  VARIANT 3, 8, 12, 14: Xaa = Any Amino Acid
CCXEYCCXNPAXCXTGCY

SEQ ID NO: 520 - protein, 18 aa, Artificial Sequence
  Synthetically generated peptide
  VARIANT 3, 8, 12, 15: Xaa = Any Amino Acid
CCXEYCCXNPAXCTXGCY

SEQ ID NO: 521 - protein, 18 aa, Artificial Sequence
  Synthetically generated peptide
  VARIANT 3, 8, 12, 16: Xaa = Any Amino Acid
CCXEYCCXNPAXCTGXCY

SEQ ID NO: 522 - protein, 18 aa, Artificial Sequence
  Synthetically generated peptide
  VARIANT 3, 8, 12, 17: Xaa = Any Amino Acid
CCXEYCCXNPAXCTGCXY

SEQ ID NO: 523 - protein, 17 aa, Artificial Sequence
  Synthetically generated peptide
  VARIANT 3, 8, 13: Xaa = Any Amino Acid
CCXEYCCXNPACXTGCY

SEQ ID NO: 524 - protein, 18 aa, Artificial Sequence
  Synthetically generated peptide
  VARIANT 3, 8, 13, 14: Xaa = Any Amino Acid
CCXEYCCXNPACXXTGCY

SEQ ID NO: 525 - protein, 18 aa, Artificial Sequence
  Synthetically generated peptide
  VARIANT 3, 8, 13, 15: Xaa = Any Amino Acid
CCXEYCCXNPACXTXGCY

SEQ ID NO: 526 - protein, 18 aa, Artificial Sequence
  Synthetically generated peptide
  VARIANT 3, 8, 13, 16: Xaa = Any Amino Acid
CCXEYCCXNPACXTGXCY

SEQ ID NO: 527 - protein, 18 aa, Artificial Sequence
  Synthetically generated peptide
  VARIANT 3, 8, 13, 17: Xaa = Any Amino Acid
CCXEYCCXNPACXTGCXY

SEQ ID NO: 528 - protein, 17 aa, Artificial Sequence
  Synthetically generated peptide
  VARIANT 3, 8, 14: Xaa = Any Amino Acid
CCXEYCCXNPACTXGCY

SEQ ID NO: 529 - protein, 18 aa, Artificial Sequence
  Synthetically generated peptide
  VARIANT 3, 8, 14, 15: Xaa = Any Amino Acid
CCXEYCCXNPACTXXGCY

SEQ ID NO: 530 - protein, 18 aa, Artificial Sequence
  Synthetically generated peptide
  VARIANT 3, 8, 14, 16: Xaa = Any Amino Acid
CCXEYCCXNPACTXGXCY

SEQ ID NO: 531 - protein, 18 aa, Artificial Sequence
  Synthetically generated peptide
  VARIANT 3, 8, 14, 17: Xaa = Any Amino Acid
CCXEYCCXNPACTXGCXY

SEQ ID NO: 532 - protein, 17 aa, Artificial Sequence
  Synthetically generated peptide
  VARIANT 3, 8, 15: Xaa = Any Amino Acid
CCXEYCCXNPACTGXCY

SEQ ID NO: 533 - protein, 18 aa, Artificial Sequence
  Synthetically generated peptide
  VARIANT 3, 8, 15, 16: Xaa = Any Amino Acid
CCXEYCCXNPACTGXXCY

SEQ ID NO: 534 - protein, 18 aa, Artificial Sequence
  Synthetically generated peptide
  VARIANT 3, 8, 15, 17 ): Xaa = Any Amino Acid
CCXEYCCXNPACTGXCXY

SEQ ID NO: 535 - protein, 17 aa, Artificial Sequence
  Synthetically generated peptide
  VARIANT 3, 8, 16: Xaa = Any Amino Acid
CCXEYCCXNPACTGCXY

SEQ ID NO: 536 - protein, 18 aa, Artificial Sequence
  Synthetically generated peptide
  VARIANT 3, 8, 16, 17: Xaa = Any Amino Acid
CCXEYCCXNPACTGCXXY

SEQ ID NO: 537 - protein, 16 aa, Artificial Sequence
  Synthetically generated peptide
  VARIANT 3, 9: Xaa = Any Amino Acid
CCXEYCCNXPACTGCY

SEQ ID NO: 538 - protein, 17 aa, Artificial Sequence
  Synthetically generated peptide
  VARIANT 3, 9, 10: Xaa = Any Amino Acid
CCXEYCCNXXPACTGCY

SEQ ID NO: 539 - protein, 18 aa, Artificial Sequence
  Synthetically generated peptide
  VARIANT 3, 9, 10, 11: Xaa = Any Amino Acid
CCXEYCCNXXXPACTGCY

SEQ ID NO: 540 - protein, 18 aa, Artificial Sequence
  Synthetically generated peptide
  VARIANT 3, 9, 10, 12: Xaa = Any Amino Acid
CCXEYCCNXXPXACTGCY

SEQ ID NO: 541 - protein, 18 aa, Artificial Sequence
  Synthetically generated peptide
  VARIANT 3, 9, 10, 13: Xaa = Any Amino Acid
CCXEYCCNXXPAXCTGCY

SEQ ID NO: 542 - protein, 18 aa, Artificial Sequence
  Synthetically generated peptide
  VARIANT 3, 9, 10, 14: Xaa = Any Amino Acid
CCXEYCCNXXPACXTGCY

SEQ ID NO: 543 - protein, 18 aa, Artificial Sequence
  Synthetically generated peptide
  VARIANT 3, 9, 10, 15: Xaa = Any Amino Acid
CCXEYCCNXXPACTXGCY

SEQ ID NO: 544 - protein, 18 aa, Artificial Sequence
  Synthetically generated peptide
  VARIANT 3, 9, 10, 16: Xaa = Any Amino Acid
CCXEYCCNXXPACTGXCY

SEQ ID NO: 545 - protein, 18 aa, Artificial Sequence
  Synthetically generated peptide
  VARIANT 3, 9, 10, 17: Xaa = Any Amino Acid
CCXEYCCNXXPACTGCXY

SEQ ID NO: 546 - protein, 17 aa, Artificial Sequence
  Synthetically generated peptide
  VARIANT 3, 9, 11: Xaa = Any Amino Acid
CCXEYCCNXPXACTGCY

SEQ ID NO: 547 - protein, 18 aa, Artificial Sequence
  Synthetically generated peptide
  VARIANT 3, 9, 11, 12: Xaa = Any Amino Acid
CCXEYCCNXPXXACTGCY

SEQ ID NO: 548 - protein, 18 aa, Artificial Sequence
  Synthetically generated peptide
  VARIANT 3, 9, 11, 13: Xaa = Any Amino Acid
CCXEYCCNXPXAXCTGCY

SEQ ID NO: 549 - protein, 18 aa, Artificial Sequence
  Synthetically generated peptide
  VARIANT 3, 9, 11, 14: Xaa = Any Amino Acid
CCXEYCCNXPXACXTGCY

SEQ ID NO: 550 - protein, 18 aa, Artificial Sequence
  Synthetically generated peptide
  VARIANT 3, 9, 11, 15: Xaa = Any Amino Acid
CCXEYCCNXPXACTXGCY

SEQ ID NO: 551 - protein, 18 aa, Artificial Sequence
  Synthetically generated peptide
  VARIANT 3, 9, 11, 16: Xaa = Any Amino Acid
CCXEYCCNXPXACTGXCY

SEQ ID NO: 552 - protein, 18 aa, Artificial Sequence
  Synthetically generated peptide
  VARIANT 3, 9, 11, 17: Xaa = Any Amino Acid
CCXEYCCNXPXACTGCXY

SEQ ID NO: 553 - protein, 17 aa, Artificial Sequence
  Synthetically generated peptide
  VARIANT 3, 9, 12: Xaa = Any Amino Acid
CCXEYCCNXPAXCTGCY

SEQ ID NO: 554 - protein, 18 aa, Artificial Sequence
  Synthetically generated peptide
  VARIANT 3, 9, 12, 13: Xaa = Any Amino Acid
CCXEYCCNXPAXXCTGCY

SEQ ID NO: 555 - protein, 18 aa, Artificial Sequence
  Synthetically generated peptide
  VARIANT 3, 9, 12, 14: Xaa = Any Amino Acid
CCXEYCCNXPAXCXTGCY

SEQ ID NO: 556 - protein, 18 aa, Artificial Sequence
  Synthetically generated peptide
  VARIANT 3, 9, 12, 15: Xaa = Any Amino Acid
CCXEYCCNXPAXCTXGCY

SEQ ID NO: 557 - protein, 18 aa, Artificial Sequence
  Synthetically generated peptide
  VARIANT 3, 9, 12, 16: Xaa = Any Amino Acid
CCXEYCCNXPAXCTGXCY

SEQ ID NO: 558 - protein, 18 aa, Artificial Sequence
  Synthetically generated peptide
  VARIANT 3, 9, 12, 17: Xaa = Any Amino Acid
CCXEYCCNXPAXCTGCXY

SEQ ID NO: 559 - protein, 17 aa, Artificial Sequence
  Synthetically generated peptide
  VARIANT 3, 9, 13: Xaa = Any Amino Acid
CCXEYCCNXPACXTGCY

SEQ ID NO: 560 - protein, 18 aa, Artificial Sequence
  Synthetically generated peptide
  VARIANT 3, 9, 13, 14: Xaa = Any Amino Acid
CCXEYCCNXPACXXTGCY

SEQ ID NO: 561 - protein, 18 aa, Artificial Sequence
  Synthetically generated peptide
  VARIANT 3, 9, 13, 15: Xaa = Any Amino Acid
CCXEYCCNXPACXTXGCY

SEQ ID NO: 562 - protein, 18 aa, Artificial Sequence
  Synthetically generated peptide
  VARIANT 3, 9, 13, 16: Xaa = Any Amino Acid
CCXEYCCNXPACXTGXCY

SEQ ID NO: 563 - protein, 18 aa, Artificial Sequence
  Synthetically generated peptide
  VARIANT 3, 9, 13, 17: Xaa = Any Amino Acid
CCXEYCCNXPACXTGCXY

SEQ ID NO: 564 - protein, 17 aa, Artificial Sequence
  Synthetically generated peptide
  VARIANT 3, 9, 14: Xaa = Any Amino Acid
CCXEYCCNXPACTXGCY

SEQ ID NO: 565 - protein, 18 aa, Artificial Sequence
  Synthetically generated peptide
  VARIANT 3, 9, 14, 15: Xaa = Any Amino Acid
CCXEYCCNXPACTXXGCY

SEQ ID NO: 566 - protein, 18 aa, Artificial Sequence
  Synthetically generated peptide
  VARIANT 3, 9, 14, 16: Xaa = Any Amino Acid
CCXEYCCNXPACTXGXCY

SEQ ID NO: 567 - protein, 18 aa, Artificial Sequence
  Synthetically generated peptide
  VARIANT 3, 9, 14, 17: Xaa = Any Amino Acid
CCXEYCCNXPACTXGCXY

SEQ ID NO: 568 - protein, 17 aa, Artificial Sequence
  Synthetically generated peptide
  VARIANT 3, 9, 15: Xaa = Any Amino Acid
CCXEYCCNXPACTGXCY

SEQ ID NO: 569 - protein, 18 aa, Artificial Sequence
  Synthetically generated peptide
  VARIANT 3, 9, 15, 16: Xaa = Any Amino Acid
CCXEYCCNXPACTGXXCY

SEQ ID NO: 570 - protein, 18 aa, Artificial Sequence
  Synthetically generated peptide
  VARIANT 3, 9, 15, 17: Xaa = Any Amino Acid
CCXEYCCNXPACTGXCXY

SEQ ID NO: 571 - protein, 17 aa, Artificial Sequence
  Synthetically generated peptide
  VARIANT 3, 9, 16: Xaa = Any Amino Acid
CCXEYCCNXPACTGCXY

SEQ ID NO: 572 - protein, 18 aa, Artificial Sequence
  Synthetically generated peptide
  VARIANT 3, 9, 16, 17: Xaa = Any Amino Acid
CCXEYCCNXPACTGCXXY

SEQ ID NO: 573 - protein, 16 aa, Artificial Sequence
  Synthetically generated peptide
  VARIANT 3, 10: Xaa = Any Amino Acid
CCXEYCCNPXACTGCY

SEQ ID NO: 574 - protein, 17 aa, Artificial Sequence
  Synthetically generated peptide
  VARIANT 3, 10, 11: Xaa = Any Amino Acid
CCXEYCCNPXXACTGCY

SEQ ID NO: 575 - protein, 18 aa, Artificial Sequence
  Synthetically generated peptide
  VARIANT 3, 10, 11, 12: Xaa = Any Amino Acid
CCXEYCCNPXXXACTGCY

SEQ ID NO: 576 - protein, 18 aa, Artificial Sequence
  Synthetically generated peptide
  VARIANT 3, 10, 11, 13: Xaa = Any Amino Acid
CCXEYCCNPXXAXCTGCY

SEQ ID NO: 577 - protein, 18 aa, Artificial Sequence
  Synthetically generated peptide
  VARIANT 3, 10, 11, 14: Xaa = Any Amino Acid
CCXEYCCNPXXACXTGCY

SEQ ID NO: 578 - protein, 18 aa, Artificial Sequence
  Synthetically generated peptide
  VARIANT 3, 10, 11, 15: Xaa = Any Amino Acid
CCXEYCCNPXXACTXGCY

SEQ ID NO: 579 - protein, 18 aa, Artificial Sequence
  Synthetically generated peptide
  VARIANT 3, 10, 11, 16: Xaa = Any Amino Acid
CCXEYCCNPXXACTGXCY

SEQ ID NO: 580 - protein, 18 aa, Artificial Sequence
  Synthetically generated peptide
  VARIANT 3, 10, 11, 17: Xaa = Any Amino Acid
CCXEYCCNPXXACTGCXY

SEQ ID NO: 581 - protein, 17 aa, Artificial Sequence
  Synthetically generated peptide
  VARIANT 3, 10, 12: Xaa = Any Amino Acid
CCXEYCCNPXAXCTGCY

SEQ ID NO: 582 - protein, 18 aa, Artificial Sequence
  Synthetically generated peptide
  VARIANT 3, 10, 12, 13 ): Xaa = Any Amino Acid
CCXEYCCNPXAXXCTGCY

SEQ ID NO: 583 - protein, 18 aa, Artificial Sequence
  Synthetically generated peptide
  VARIANT 3, 10, 12, 14: Xaa = Any Amino Acid
CCXEYCCNPXAXCXTGCY

SEQ ID NO: 584 - protein, 18 aa, Artificial Sequence
  Synthetically generated peptide
  VARIANT 3, 10, 12, 15: Xaa = Any Amino Acid
CCXEYCCNPXAXCTXGCY

SEQ ID NO: 585 - protein, 18 aa, Artificial Sequence
  Synthetically generated peptide
  VARIANT 3, 10, 12, 16: Xaa = Any Amino Acid
CCXEYCCNPXAXCTGXCY

SEQ ID NO: 586 - protein, 18 aa, Artificial Sequence
  Synthetically generated peptide
  VARIANT 3, 10, 12, 17: Xaa = Any Amino Acid
CCXEYCCNPXAXCTGCXY

SEQ ID NO: 587 - protein, 17 aa, Artificial Sequence
  Synthetically generated peptide
  VARIANT 3, 10, 13: Xaa = Any Amino Acid
CCXEYCCNPXACXTGCY

SEQ ID NO: 588 - protein, 18 aa, Artificial Sequence
  Synthetically generated peptide
  VARIANT 3, 10, 13, 14: Xaa = Any Amino Acid
CCXEYCCNPXACXXTGCY

SEQ ID NO: 589 - protein, 18 aa, Artificial Sequence
  Synthetically generated peptide
  VARIANT 3, 10, 13, 15: Xaa = Any Amino Acid
CCXEYCCNPXACXTXGCY

SEQ ID NO: 590 - protein, 18 aa, Artificial Sequence
  Synthetically generated peptide
  VARIANT 3, 10, 13, 16: Xaa = Any Amino Acid
CCXEYCCNPXACXTGXCY

SEQ ID NO: 591 - protein, 18 aa, Artificial Sequence
  Synthetically generated peptide
  VARIANT 3, 10, 13, 17: Xaa = Any Amino Acid
CCXEYCCNPXACXTGCXY

SEQ ID NO: 592 - protein, 17 aa, Artificial Sequence
  Synthetically generated peptide
  VARIANT 3, 10, 14: Xaa = Any Amino Acid
CCXEYCCNPXACTXGCY

SEQ ID NO: 593 - protein, 18 aa, Artificial Sequence
  Synthetically generated peptide
  VARIANT 3, 10, 14, 15: Xaa = Any Amino Acid
CCXEYCCNPXACTXXGCY

SEQ ID NO: 594 - protein, 18 aa, Artificial Sequence
  Synthetically generated peptide
  VARIANT 3, 10, 14, 16: Xaa = Any Amino Acid
CCXEYCCNPXACTXGXCY

SEQ ID NO: 595 - protein, 18 aa, Artificial Sequence
  Synthetically generated peptide
  VARIANT 3, 10, 14, 17: Xaa = Any Amino Acid
CCXEYCCNPXACTXGCXY

SEQ ID NO: 596 - protein, 17 aa, Artificial Sequence
  Synthetically generated peptide
  VARIANT 3, 10, 15: Xaa = Any Amino Acid
CCXEYCCNPXACTGXCY

SEQ ID NO: 597 - protein, 18 aa, Artificial Sequence
  Synthetically generated peptide
  VARIANT 3, 10, 15, 16: Xaa = Any Amino Acid
CCXEYCCNPXACTGXXCY

SEQ ID NO: 598 - protein, 18 aa, Artificial Sequence
  Synthetically generated peptide
  VARIANT 3, 10, 15, 17: Xaa = Any Amino Acid
CCXEYCCNPXACTGXCXY

SEQ ID NO: 599 - protein, 17 aa, Artificial Sequence
  Synthetically generated peptide
  VARIANT 3, 10, 16: Xaa = Any Amino Acid
CCXEYCCNPXACTGCXY

SEQ ID NO: 600 - protein, 18 aa, Artificial Sequence
  Synthetically generated peptide
  VARIANT 3, 10, 16, 17: Xaa = Any Amino Acid
CCXEYCCNPXACTGCXXY

SEQ ID NO: 601 - protein, 16 aa, Artificial Sequence
  Synthetically generated peptide
  VARIANT 3, 11: Xaa = Any Amino Acid
CCXEYCCNPAXCTGCY

SEQ ID NO: 602 - protein, 17 aa, Artificial Sequence
  Synthetically generated peptide
  VARIANT 3, 11, 12: Xaa = Any Amino Acid
CCXEYCCNPAXXCTGCY

SEQ ID NO: 603 - protein, 18 aa, Artificial Sequence
  Synthetically generated peptide
  VARIANT 3, 11, 12, 13: Xaa = Any Amino Acid
CCXEYCCNPAXXXCTGCY

SEQ ID NO: 604 - protein, 18 aa, Artificial Sequence
  Synthetically generated peptide
  VARIANT 3, 11, 12, 14: Xaa = Any Amino Acid
CCXEYCCNPAXXCXTGCY

SEQ ID NO: 605 - protein, 18 aa, Artificial Sequence
  Synthetically generated peptide
  VARIANT 3, 11, 12, 15: Xaa = Any Amino Acid
CCXEYCCNPAXXCTXGCY

SEQ ID NO: 606 - protein, 18 aa, Artificial Sequence
  Synthetically generated peptide
  VARIANT 3, 11, 12, 16: Xaa = Any Amino Acid
CCXEYCCNPAXXCTGXCY

SEQ ID NO: 607 - protein, 18 aa, Artificial Sequence
  Synthetically generated peptide
  VARIANT 3, 11, 12, 17: Xaa = Any Amino Acid
CCXEYCCNPAXXCTGCXY

SEQ ID NO: 608 - protein, 17 aa, Artificial Sequence
  Synthetically generated peptide
  VARIANT 3, 11, 13: Xaa = Any Amino Acid
CCXEYCCNPAXCXTGCY

SEQ ID NO: 609 - protein, 18 aa, Artificial Sequence
  Synthetically generated peptide
  VARIANT 3, 11, 13, 14: Xaa = Any Amino Acid
CCXEYCCNPAXCXXTGCY

SEQ ID NO: 610 - protein, 18 aa, Artificial Sequence
  Synthetically generated peptide
  VARIANT 3, 11, 13, 15: Xaa = Any Amino Acid
CCXEYCCNPAXCXTXGCY

SEQ ID NO: 611 - protein, 18 aa, Artificial Sequence
  Synthetically generated peptide
  VARIANT 3, 11, 13, 16: Xaa = Any Amino Acid
CCXEYCCNPAXCXTGXCY

SEQ ID NO: 612 - protein, 18 aa, Artificial Sequence
  Synthetically generated peptide
  VARIANT 3, 11, 13, 17: Xaa = Any Amino Acid
CCXEYCCNPAXCXTGCXY

SEQ ID NO: 613 - protein, 17 aa, Artificial Sequence
  Synthetically generated peptide
  VARIANT 3, 11, 14: Xaa = Any Amino Acid
CCXEYCCNPAXCTXGCY

SEQ ID NO: 614 - protein, 18 aa, Artificial Sequence
  Synthetically generated peptide
  VARIANT 3, 11, 14, 15: Xaa = Any Amino Acid
CCXEYCCNPAXCTXXGCY

SEQ ID NO: 615 - protein, 18 aa, Artificial Sequence
  Synthetically generated peptide
  VARIANT 3, 11, 14, 16: Xaa = Any Amino Acid
CCXEYCCNPAXCTXGXCY

SEQ ID NO: 616 - protein, 18 aa, Artificial Sequence
  Synthetically generated peptide
  VARIANT 3, 11, 14, 17: Xaa = Any Amino Acid
CCXEYCCNPAXCTXGCXY

SEQ ID NO: 617 - protein, 17 aa, Artificial Sequence
  Synthetically generated peptide
  VARIANT 3, 11, 15: Xaa = Any Amino Acid
CCXEYCCNPAXCTGXCY

SEQ ID NO: 618 - protein, 18 aa, Artificial Sequence
  Synthetically generated peptide
  VARIANT 3, 11, 15, 16: Xaa = Any Amino Acid
CCXEYCCNPAXCTGXXCY

SEQ ID NO: 619 - protein, 18 aa, Artificial Sequence
  Synthetically generated peptide
  VARIANT 3, 11, 15, 17: Xaa = Any Amino Acid
CCXEYCCNPAXCTGXCXY

SEQ ID NO: 620 - protein, 17 aa, Artificial Sequence
  Synthetically generated peptide
  VARIANT 3, 11, 16: Xaa = Any Amino Acid
CCXEYCCNPAXCTGCXY

SEQ ID NO: 621 - protein, 18 aa, Artificial Sequence
  Synthetically generated peptide
  VARIANT 3, 11, 16, 17: Xaa = Any Amino Acid
CCXEYCCNPAXCTGCXXY

SEQ ID NO: 622 - protein, 16 aa, Artificial Sequence
  Synthetically generated peptide
  VARIANT 3, 12: Xaa = Any Amino Acid
CCXEYCCNPACXTGCY

SEQ ID NO: 623 - protein, 17 aa, Artificial Sequence
  Synthetically generated peptide
  VARIANT 3, 12, 13: Xaa = Any Amino Acid
CCXEYCCNPACXXTGCY

SEQ ID NO: 624 - protein, 18 aa, Artificial Sequence
  Synthetically generated peptide
  VARIANT 3, 12, 13, 14: Xaa = Any Amino Acid
CCXEYCCNPACXXXTGCY

SEQ ID NO: 625 - protein, 18 aa, Artificial Sequence
  Synthetically generated peptide
  VARIANT 3, 12, 13, 15: Xaa = Any Amino Acid
CCXEYCCNPACXXTXGCY

SEQ ID NO: 626 - protein, 18 aa, Artificial Sequence
  Synthetically generated peptide
  VARIANT 3, 12, 13, 16: Xaa = Any Amino Acid
CCXEYCCNPACXXTGXCY

SEQ ID NO: 627 - protein, 18 aa, Artificial Sequence
  Synthetically generated peptide
  VARIANT 3, 12, 13, 17: Xaa = Any Amino Acid
CCXEYCCNPACXXTGCXY

SEQ ID NO: 628 - protein, 17 aa, Artificial Sequence
  Synthetically generated peptide
  VARIANT 3, 12, 14: Xaa = Any Amino Acid
CCXEYCCNPACXTXGCY

SEQ ID NO: 629 - protein, 18 aa, Artificial Sequence
  Synthetically generated peptide
  VARIANT 3, 12, 14, 15: Xaa = Any Amino Acid
CCXEYCCNPACXTXXGCY

SEQ ID NO: 630 - protein, 18 aa, Artificial Sequence
  Synthetically generated peptide
  VARIANT 3, 12, 14, 16: Xaa = Any Amino Acid
CCXEYCCNPACXTXGXCY

SEQ ID NO: 631 - protein, 18 aa, Artificial Sequence
  Synthetically generated peptide
  VARIANT 3, 12, 14, 17: Xaa = Any Amino Acid
CCXEYCCNPACXTXGCXY

SEQ ID NO: 632 - protein, 17 aa, Artificial Sequence
  Synthetically generated peptide
  VARIANT 3, 12, 15: Xaa = Any Amino Acid
CCXEYCCNPACXTGXCY

SEQ ID NO: 633 - protein, 18 aa, Artificial Sequence
  Synthetically generated peptide
  VARIANT 3, 12, 15, 16: Xaa = Any Amino Acid
CCXEYCCNPACXTGXXCY

SEQ ID NO: 634 - protein, 18 aa, Artificial Sequence
  Synthetically generated peptide
  VARIANT 3, 12, 15, 17: Xaa = Any Amino Acid
CCXEYCCNPACXTGXCXY

SEQ ID NO: 635 - protein, 17 aa, Artificial Sequence
  Synthetically generated peptide
  VARIANT 3, 12, 16: Xaa = Any Amino Acid
CCXEYCCNPACXTGCXY

SEQ ID NO: 636 - protein, 18 aa, Artificial Sequence
  Synthetically generated peptide
  VARIANT 3, 12, 16, 17: Xaa = Any Amino Acid
CCXEYCCNPACXTGCXXY

SEQ ID NO: 637 - protein, 16 aa, Artificial Sequence
  Synthetically generated peptide
  VARIANT 3, 13: Xaa = Any Amino Acid
CCXEYCCNPACTXGCY

SEQ ID NO: 638 - protein, 17 aa, Artificial Sequence
  Synthetically generated peptide
  VARIANT 3, 13, 14: Xaa = Any Amino Acid
CCXEYCCNPACTXXGCY

SEQ ID NO: 639 - protein, 18 aa, Artificial Sequence
  Synthetically generated peptide
  VARIANT 3, 13, 14, 15: Xaa = Any Amino Acid
CCXEYCCNPACTXXXGCY

SEQ ID NO: 640 - protein, 18 aa, Artificial Sequence
  Synthetically generated peptide
  VARIANT 3, 13, 14, 16: Xaa = Any Amino Acid
CCXEYCCNPACTXXGXCY

SEQ ID NO: 641 - protein, 18 aa, Artificial Sequence
  Synthetically generated peptide
  VARIANT 3, 13, 14, 17: Xaa = Any Amino Acid
CCXEYCCNPACTXXGCXY

SEQ ID NO: 642 - protein, 17 aa, Artificial Sequence
  Synthetically generated peptide
  VARIANT 3, 13, 15: Xaa = Any Amino Acid
CCXEYCCNPACTXGXCY

SEQ ID NO: 643 - protein, 18 aa, Artificial Sequence
  Synthetically generated peptide
  VARIANT 3, 13, 15, 16: Xaa = Any Amino Acid
CCXEYCCNPACTXGXXCY

SEQ ID NO: 644 - protein, 18 aa, Artificial Sequence
  Synthetically generated peptide
  VARIANT 3, 13, 15, 17: Xaa = Any Amino Acid
CCXEYCCNPACTXGXCXY

SEQ ID NO: 645 - protein, 17 aa, Artificial Sequence
  Synthetically generated peptide
  VARIANT 3, 13, 16: Xaa = Any Amino Acid
CCXEYCCNPACTXGCXY

SEQ ID NO: 646 - protein, 18 aa, Artificial Sequence
  Synthetically generated peptide
  VARIANT 3, 13, 16, 17: Xaa = Any Amino Acid
CCXEYCCNPACTXGCXXY

SEQ ID NO: 647 - protein, 16 aa, Artificial Sequence
  Synthetically generated peptide
  VARIANT 3, 14: Xaa = Any Amino Acid
CCXEYCCNPACTGXCY

SEQ ID NO: 648 - protein, 17 aa, Artificial Sequence
  Synthetically generated peptide
  VARIANT 3, 14, 15: Xaa = Any Amino Acid
CCXEYCCNPACTGXXCY

SEQ ID NO: 649 - protein, 18 aa, Artificial Sequence
  Synthetically generated peptide
  VARIANT 3, 14, 15, 16: Xaa = Any Amino Acid
CCXEYCCNPACTGXXXCY

SEQ ID NO: 650 - protein, 18 aa, Artificial Sequence
  Synthetically generated peptide
  VARIANT 3, 14, 15, 17: Xaa = Any Amino Acid
CCXEYCCNPACTGXXCXY

SEQ ID NO: 651 - protein, 17 aa, Artificial Sequence
  Synthetically generated peptide
  VARIANT 3, 14, 16: Xaa = Any Amino Acid
CCXEYCCNPACTGXCXY

SEQ ID NO: 652 - protein, 18 aa, Artificial Sequence
  Synthetically generated peptide
  VARIANT 3, 14, 16, 17: Xaa = Any Amino Acid
CCXEYCCNPACTGXCXXY

SEQ ID NO: 653 - protein, 16 aa, Artificial Sequence
  Synthetically generated peptide
  VARIANT 3, 15: Xaa = Any Amino Acid
CCXEYCCNPACTGCXY

SEQ ID NO: 654 - protein, 17 aa, Artificial Sequence
  Synthetically generated peptide
  VARIANT 3, 15, 16: Xaa = Any Amino Acid
CCXEYCCNPACTGCXXY

SEQ ID NO: 655 - protein, 18 aa, Artificial Sequence
  Synthetically generated peptide
  VARIANT 3, 15, 16, 17: Xaa = Any Amino Acid
CCXEYCCNPACTGCXXXY

SEQ ID NO: 656 - protein, 15 aa, Artificial Sequence
  Synthetically generated peptide
  VARIANT 4: Xaa = Any Amino Acid
CCEXYCCNPACTGCY

SEQ ID NO: 657 - protein, 16 aa, Artificial Sequence
  Synthetically generated peptide
  VARIANT 4, 5: Xaa = Any Amino Acid
CCEXXYCCNPACTGCY

SEQ ID NO: 658 - protein, 17 aa, Artificial Sequence
  Synthetically generated peptide
  VARIANT 4, 5, 6: Xaa = Any Amino Acid
CCEXXXYCCNPACTGCY

SEQ ID NO: 659 - protein, 18 aa, Artificial Sequence
  Synthetically generated peptide
  VARIANT 4, 5, 6, 7: Xaa = Any Amino Acid
CCEXXXXYCCNPACTGCY

SEQ ID NO: 660 - protein, 18 aa, Artificial Sequence
  Synthetically generated peptide
  VARIANT 4, 5, 6, 8: Xaa = Any Amino Acid
CCEXXXYXCCNPACTGCY

SEQ ID NO: 661 - protein, 18 aa, Artificial Sequence
  Synthetically generated peptide
  VARIANT 4, 5, 6, 10: Xaa = Any Amino Acid
CCEXXXYCCXNPACTGCY

SEQ ID NO: 662 - protein, 18 aa, Artificial Sequence
  Synthetically generated peptide
  VARIANT 4, 5, 6, 11: Xaa = Any Amino Acid
CCEXXXYCCNXPACTGCY

SEQ ID NO: 663 - protein, 18 aa, Artificial Sequence
  Synthetically generated peptide
  VARIANT 4, 5, 6, 12: Xaa = Any Amino Acid
CCEXXXYCCNPXACTGCY

SEQ ID NO: 664 - protein, 18 aa, Artificial Sequence
  Synthetically generated peptide
  VARIANT 4, 5, 6, 13: Xaa = Any Amino Acid
CCEXXXYCCNPAXCTGCY

SEQ ID NO: 665 - protein, 18 aa, Artificial Sequence
  Synthetically generated peptide
  VARIANT 4, 5, 6, 14: Xaa = Any Amino Acid
CCEXXXYCCNPACXTGCY

SEQ ID NO: 666 - protein, 18 aa, Artificial Sequence
  Synthetically generated peptide
  VARIANT 4, 5, 6, 15: Xaa = Any Amino Acid
CCEXXXYCCNPACTXGCY

SEQ ID NO: 667 - protein, 18 aa, Artificial Sequence
  Synthetically generated peptide
  VARIANT 4, 5, 6, 16: Xaa = Any Amino Acid
CCEXXXYCCNPACTGXCY

SEQ ID NO: 668 - protein, 18 aa, Artificial Sequence
  Synthetically generated peptide
  VARIANT 4, 5, 6, 17: Xaa = Any Amino Acid
CCEXXXYCCNPACTGCXY

SEQ ID NO: 669 - protein, 17 aa, Artificial Sequence
  Synthetically generated peptide
  VARIANT 4, 5, 7: Xaa = Any Amino Acid
CCEXXYXCCNPACTGCY

SEQ ID NO: 670 - protein, 18 aa, Artificial Sequence
  Synthetically generated peptide
  VARIANT 4, 5, 7, 8: Xaa = Any Amino Acid
CCEXXYXXCCNPACTGCY

SEQ ID NO: 671 - protein, 18 aa, Artificial Sequence
  Synthetically generated peptide
  VARIANT 4, 5, 7, 10: Xaa = Any Amino Acid
CCEXXYXCCXNPACTGCY

SEQ ID NO: 672 - protein, 18 aa, Artificial Sequence
  Synthetically generated peptide
  VARIANT 4, 5, 7, 11: Xaa = Any Amino Acid
CCEXXYXCCNXPACTGCY

SEQ ID NO: 673 - protein, 18 aa, Artificial Sequence
  Synthetically generated peptide
  VARIANT 4, 5, 7, 12: Xaa = Any Amino Acid
CCEXXYXCCNPXACTGCY

SEQ ID NO: 674 - protein, 18 aa, Artificial Sequence
  Synthetically generated peptide
  VARIANT 4, 5, 7, 13: Xaa = Any Amino Acid
CCEXXYXCCNPAXCTGCY

SEQ ID NO: 675 - protein, 18 aa, Artificial Sequence
  Synthetically generated peptide
  VARIANT 4, 5, 7, 14: Xaa = Any Amino Acid
CCEXXYXCCNPACXTGCY

SEQ ID NO: 676 - protein, 18 aa, Artificial Sequence
  Synthetically generated peptide
  VARIANT 4, 5, 7, 15: Xaa = Any Amino Acid
CCEXXYXCCNPACTXGCY

SEQ ID NO: 677 - protein, 18 aa, Artificial Sequence
  Synthetically generated peptide
  VARIANT 4, 5, 7, 16: Xaa = Any Amino Acid
CCEXXYXCCNPACTGXCY

SEQ ID NO: 678 - protein, 18 aa, Artificial Sequence
  Synthetically generated peptide
  VARIANT 4, 5, 7, 17: Xaa = Any Amino Acid
CCEXXYXCCNPACTGCXY

SEQ ID NO: 679 - protein, 17 aa, Artificial Sequence
  Synthetically generated peptide
  VARIANT 4, 5, 9: Xaa = Any Amino Acid
CCEXXYCCXNPACTGCY

SEQ ID NO: 680 - protein, 18 aa, Artificial Sequence
  Synthetically generated peptide
  VARIANT 4, 5, 9, 10: Xaa = Any Amino Acid
CCEXXYCCXXNPACTGCY

SEQ ID NO: 681 - protein, 18 aa, Artificial Sequence
  Synthetically generated peptide
  VARIANT 4, 5, 9, 11: Xaa = Any Amino Acid
CCEXXYCCXNXPACTGCY

SEQ ID NO: 682 - protein, 18 aa, Artificial Sequence
  Synthetically generated peptide
  VARIANT 4, 5, 9, 12: Xaa = Any Amino Acid
CCEXXYCCXNPXACTGCY

SEQ ID NO: 683 - protein, 18 aa, Artificial Sequence
  Synthetically generated peptide
  VARIANT 4, 5, 9, 13: Xaa = Any Amino Acid
CCEXXYCCXNPAXCTGCY

SEQ ID NO: 684 - protein, 18 aa, Artificial Sequence
  Synthetically generated peptide
  VARIANT 4, 5, 9, 14: Xaa = Any Amino Acid
CCEXXYCCXNPACXTGCY

SEQ ID NO: 685 - protein, 18 aa, Artificial Sequence
  Synthetically generated peptide
  VARIANT 4, 5, 9, 15: Xaa = Any Amino Acid
CCEXXYCCXNPACTXGCY

SEQ ID NO: 686 - protein, 18 aa, Artificial Sequence
  Synthetically generated peptide
  VARIANT 4, 5, 9, 16: Xaa = Any Amino Acid
CCEXXYCCXNPACTGXCY

SEQ ID NO: 687 - protein, 18 aa, Artificial Sequence
  Synthetically generated peptide
  VARIANT 4, 5, 9, 17: Xaa = Any Amino Acid
CCEXXYCCXNPACTGCXY

SEQ ID NO: 688 - protein, 17 aa, Artificial Sequence
  Synthetically generated peptide
  VARIANT 4, 5, 10: Xaa = Any Amino Acid
CCEXXYCCNXPACTGCY

SEQ ID NO: 689 - protein, 18 aa, Artificial Sequence
  Synthetically generated peptide
  VARIANT 4, 5, 10, 11: Xaa = Any Amino Acid
CCEXXYCCNXXPACTGCY

SEQ ID NO: 690 - protein, 18 aa, Artificial Sequence
  Synthetically generated peptide
  VARIANT 4, 5, 10, 12: Xaa = Any Amino Acid
CCEXXYCCNXPXACTGCY

SEQ ID NO: 691 - protein, 18 aa, Artificial Sequence
  Synthetically generated peptide
  VARIANT 4, 5, 10, 13: Xaa = Any Amino Acid
CCEXXYCCNXPAXCTGCY

SEQ ID NO: 692 - protein, 18 aa, Artificial Sequence
  Synthetically generated peptide
  VARIANT 4, 5, 10, 14: Xaa = Any Amino Acid
CCEXXYCCNXPACXTGCY

SEQ ID NO: 693 - protein, 18 aa, Artificial Sequence
  Synthetically generated peptide
  VARIANT 4, 5, 10, 15: Xaa = Any Amino Acid
CCEXXYCCNXPACTXGCY

SEQ ID NO: 694 - protein, 18 aa, Artificial Sequence
  Synthetically generated peptide
  VARIANT 4, 5, 10, 16: Xaa = Any Amino Acid
CCEXXYCCNXPACTGXCY

SEQ ID NO: 695 - protein, 18 aa, Artificial Sequence
  Synthetically generated peptide
  VARIANT 4, 5, 10, 17: Xaa = Any Amino Acid
CCEXXYCCNXPACTGCXY

SEQ ID NO: 696 - protein, 17 aa, Artificial Sequence
  Synthetically generated peptide
  VARIANT 4, 5, 11: Xaa = Any Amino Acid
CCEXXYCCNPXACTGCY

SEQ ID NO: 697 - protein, 18 aa, Artificial Sequence
  Synthetically generated peptide
  VARIANT 4, 5, 11, 12: Xaa = Any Amino Acid
CCEXXYCCNPXXACTGCY

SEQ ID NO: 698 - protein, 18 aa, Artificial Sequence
  Synthetically generated peptide
  VARIANT 4, 5, 11, 13: Xaa = Any Amino Acid
CCEXXYCCNPXAXCTGCY

SEQ ID NO: 699 - protein, 18 aa, Artificial Sequence
  Synthetically generated peptide
  VARIANT 4, 5, 11, 14: Xaa = Any Amino Acid
CCEXXYCCNPXACXTGCY

SEQ ID NO: 700 - protein, 18 aa, Artificial Sequence
  Synthetically generated peptide
  VARIANT 4, 5, 11, 15: Xaa = Any Amino Acid
CCEXXYCCNPXACTXGCY

SEQ ID NO: 701 - protein, 18 aa, Artificial Sequence
  Synthetically generated peptide
  VARIANT 4, 5, 11, 16: Xaa = Any Amino Acid
CCEXXYCCNPXACTGXCY

SEQ ID NO: 702 - protein, 18 aa, Artificial Sequence
  Synthetically generated peptide
  VARIANT 4, 5, 11, 17: Xaa = Any Amino Acid
CCEXXYCCNPXACTGCXY

SEQ ID NO: 703 - protein, 17 aa, Artificial Sequence
  Synthetically generated peptide
  VARIANT 4, 5, 12: Xaa = Any Amino Acid
CCEXXYCCNPAXCTGCY

SEQ ID NO: 704 - protein, 18 aa, Artificial Sequence
  Synthetically generated peptide
  VARIANT 4, 5, 12, 13: Xaa = Any Amino Acid
CCEXXYCCNPAXXCTGCY

SEQ ID NO: 705 - protein, 18 aa, Artificial Sequence
  Synthetically generated peptide
  VARIANT 4, 5, 12, 14: Xaa = Any Amino Acid
CCEXXYCCNPAXCXTGCY

SEQ ID NO: 706 - protein, 18 aa, Artificial Sequence
  Synthetically generated peptide
  VARIANT 4, 5, 12, 15: Xaa = Any Amino Acid
CCEXXYCCNPAXCTXGCY

SEQ ID NO: 707 - protein, 18 aa, Artificial Sequence
  Synthetically generated peptide
  VARIANT 4, 5, 12, 16: Xaa = Any Amino Acid
CCEXXYCCNPAXCTGXCY

SEQ ID NO: 708 - protein, 18 aa, Artificial Sequence
  Synthetically generated peptide
  VARIANT 4, 5, 12, 17: Xaa = Any Amino Acid
CCEXXYCCNPAXCTGCXY

SEQ ID NO: 709 - protein, 17 aa, Artificial Sequence
  Synthetically generated peptide
  VARIANT 4, 5, 13: Xaa = Any Amino Acid
CCEXXYCCNPACXTGCY

SEQ ID NO: 710 - protein, 18 aa, Artificial Sequence
  Synthetically generated peptide
  VARIANT 4, 5, 13, 14: Xaa = Any Amino Acid
CCEXXYCCNPACXXTGCY

SEQ ID NO: 711 - protein, 18 aa, Artificial Sequence
  Synthetically generated peptide
  VARIANT 4, 5, 13, 15: Xaa = Any Amino Acid
CCEXXYCCNPACXTXGCY

SEQ ID NO: 712 - protein, 18 aa, Artificial Sequence
  Synthetically generated peptide
  VARIANT 4, 5, 13, 16: Xaa = Any Amino Acid
CCEXXYCCNPACXTGXCY

SEQ ID NO: 713 - protein, 18 aa, Artificial Sequence
  Synthetically generated peptide
  VARIANT 4, 5, 13, 17: Xaa = Any Amino Acid
CCEXXYCCNPACXTGCXY

SEQ ID NO: 714 - protein, 17 aa, Artificial Sequence
  Synthetically generated peptide
  VARIANT 4, 5, 14: Xaa = Any Amino Acid
CCEXXYCCNPACTXGCY

SEQ ID NO: 715 - protein, 18 aa, Artificial Sequence
  Synthetically generated peptide
  VARIANT 4, 5, 14, 15: Xaa = Any Amino Acid
CCEXXYCCNPACTXXGCY

SEQ ID NO: 716 - protein, 18 aa, Artificial Sequence
  Synthetically generated peptide
  VARIANT 4, 5, 14, 16: Xaa = Any Amino Acid
CCEXXYCCNPACTXGXCY

SEQ ID NO: 717 - protein, 18 aa, Artificial Sequence
  Synthetically generated peptide
  VARIANT 4, 5, 14, 17: Xaa = Any Amino Acid
CCEXXYCCNPACTXGCXY

SEQ ID NO: 718 - protein, 17 aa, Artificial Sequence
  Synthetically generated peptide
  VARIANT 4, 5, 15: Xaa = Any Amino Acid
CCEXXYCCNPACTGXCY

SEQ ID NO: 719 - protein, 18 aa, Artificial Sequence
  Synthetically generated peptide
  VARIANT 4, 5, 15, 16: Xaa = Any Amino Acid
CCEXXYCCNPACTGXXCY

SEQ ID NO: 720 - protein, 18 aa, Artificial Sequence
  Synthetically generated peptide
  VARIANT 4, 5, 15, 17: Xaa = Any Amino Acid
CCEXXYCCNPACTGXCXY

SEQ ID NO: 721 - protein, 17 aa, Artificial Sequence
  Synthetically generated peptide
  VARIANT 4, 5, 16: Xaa = Any Amino Acid
CCEXXYCCNPACTGCXY

SEQ ID NO: 722 - protein, 18 aa, Artificial Sequence
  Synthetically generated peptide
  VARIANT 4, 5, 16, 17: Xaa = Any Amino Acid
CCEXXYCCNPACTGCXXY

SEQ ID NO: 723 - protein, 16 aa, Artificial Sequence
  Synthetically generated peptide
  VARIANT 4, 6: Xaa = Any Amino Acid
CCEXYXCCNPACTGCY

SEQ ID NO: 724 - protein, 17 aa, Artificial Sequence
  Synthetically generated peptide
  VARIANT 4, 6, 7: Xaa = Any Amino Acid
CCEXYXXCCNPACTGCY

SEQ ID NO: 725 - protein, 18 aa, Artificial Sequence
  Synthetically generated peptide
  VARIANT 4, 6, 7, 8: Xaa = Any Amino Acid
CCEXYXXXCCNPACTGCY

SEQ ID NO: 726 - protein, 18 aa, Artificial Sequence
  Synthetically generated peptide
  VARIANT 4, 6, 7, 10: Xaa = Any Amino Acid
CCEXYXXCCXNPACTGCY

SEQ ID NO: 727 - protein, 18 aa, Artificial Sequence
  Synthetically generated peptide
  VARIANT 4, 6, 7, 11: Xaa = Any Amino Acid
CCEXYXXCCNXPACTGCY

SEQ ID NO: 728 - protein, 18 aa, Artificial Sequence
  Synthetically generated peptide
  VARIANT 4, 6, 7, 12: Xaa = Any Amino Acid
CCEXYXXCCNPXACTGCY

SEQ ID NO: 729 - protein, 18 aa, Artificial Sequence
  Synthetically generated peptide
  VARIANT 4, 6, 7, 13: Xaa = Any Amino Acid
CCEXYXXCCNPAXCTGCY

SEQ ID NO: 730 - protein, 18 aa, Artificial Sequence
  Synthetically generated peptide
  VARIANT 4, 6, 7, 14: Xaa = Any Amino Acid
CCEXYXXCCNPACXTGCY

SEQ ID NO: 731 - protein, 18 aa, Artificial Sequence
  Synthetically generated peptide
  VARIANT 4, 6, 7, 15: Xaa = Any Amino Acid
CCEXYXXCCNPACTXGCY

SEQ ID NO: 732 - protein, 18 aa, Artificial Sequence
  Synthetically generated peptide
  VARIANT 4, 6, 7, 16: Xaa = Any Amino Acid
CCEXYXXCCNPACTGXCY

SEQ ID NO: 733 - protein, 18 aa, Artificial Sequence
  Synthetically generated peptide
  VARIANT 4, 6, 7, 17: Xaa = Any Amino Acid
CCEXYXXCCNPACTGCXY

SEQ ID NO: 734 - protein, 17 aa, Artificial Sequence
  Synthetically generated peptide
  VARIANT 4, 6, 9: Xaa = Any Amino Acid
CCEXYXCCXNPACTGCY

SEQ ID NO: 735 - protein, 18 aa, Artificial Sequence
  Synthetically generated peptide
  VARIANT 4, 6, 9, 10: Xaa = Any Amino Acid
CCEXYXCCXXNPACTGCY

SEQ ID NO: 736 - protein, 18 aa, Artificial Sequence
  Synthetically generated peptide
  VARIANT 4, 6, 9, 11: Xaa = Any Amino Acid
CCEXYXCCXNXPACTGCY

SEQ ID NO: 737 - protein, 18 aa, Artificial Sequence
  Synthetically generated peptide
  VARIANT 4, 6, 9, 12: Xaa = Any Amino Acid
CCEXYXCCXNPXACTGCY

SEQ ID NO: 738 - protein, 18 aa, Artificial Sequence
  Synthetically generated peptide
  VARIANT 4, 6, 9, 13: Xaa = Any Amino Acid
CCEXYXCCXNPAXCTGCY

SEQ ID NO: 739 - protein, 18 aa, Artificial Sequence
  Synthetically generated peptide
  VARIANT 4, 6, 9, 14: Xaa = Any Amino Acid
CCEXYXCCXNPACXTGCY

SEQ ID NO: 740 - protein, 18 aa, Artificial Sequence
  Synthetically generated peptide
  VARIANT 4, 6, 9, 15: Xaa = Any Amino Acid
CCEXYXCCXNPACTXGCY

SEQ ID NO: 741 - protein, 18 aa, Artificial Sequence
  Synthetically generated peptide
  VARIANT 4, 6, 9, 16: Xaa = Any Amino Acid
CCEXYXCCXNPACTGXCY

SEQ ID NO: 742 - protein, 18 aa, Artificial Sequence
  Synthetically generated peptide
  VARIANT 4, 6, 9, 17: Xaa = Any Amino Acid
CCEXYXCCXNPACTGCXY

SEQ ID NO: 743 - protein, 17 aa, Artificial Sequence
  Synthetically generated peptide
  VARIANT 4, 6, 10: Xaa = Any Amino Acid
CCEXYXCCNXPACTGCY

SEQ ID NO: 744 - protein, 18 aa, Artificial Sequence
  Synthetically generated peptide
  VARIANT 4, 6, 10, 11: Xaa = Any Amino Acid
CCEXYXCCNXXPACTGCY

SEQ ID NO: 745 - protein, 18 aa, Artificial Sequence
  Synthetically generated peptide
  VARIANT 4, 6, 10, 12: Xaa = Any Amino Acid
CCEXYXCCNXPXACTGCY

SEQ ID NO: 746 - protein, 18 aa, Artificial Sequence
  Synthetically generated peptide
  VARIANT 4, 6, 10, 13: Xaa = Any Amino Acid
CCEXYXCCNXPAXCTGCY

SEQ ID NO: 747 - protein, 18 aa, Artificial Sequence
  Synthetically generated peptide
  VARIANT 4, 6, 10, 14: Xaa = Any Amino Acid
CCEXYXCCNXPACXTGCY

SEQ ID NO: 748 - protein, 18 aa, Artificial Sequence
  Synthetically generated peptide
  VARIANT 4, 6, 10, 15: Xaa = Any Amino Acid
CCEXYXCCNXPACTXGCY

SEQ ID NO: 749 - protein, 18 aa, Artificial Sequence
  Synthetically generated peptide
  VARIANT 4, 6, 10, 16: Xaa = Any Amino Acid
CCEXYXCCNXPACTGXCY

SEQ ID NO: 750 - protein, 18 aa, Artificial Sequence
  Synthetically generated peptide
  VARIANT 4, 6, 10, 17: Xaa = Any Amino Acid
CCEXYXCCNXPACTGCXY

SEQ ID NO: 751 - protein, 17 aa, Artificial Sequence
  Synthetically generated peptide
  VARIANT 4, 6, 11: Xaa = Any Amino Acid
CCEXYXCCNPXACTGCY

SEQ ID NO: 752 - protein, 18 aa, Artificial Sequence
  Synthetically generated peptide
  VARIANT 4, 6, 11, 12: Xaa = Any Amino Acid
CCEXYXCCNPXXACTGCY

SEQ ID NO: 753 - protein, 18 aa, Artificial Sequence
  Synthetically generated peptide
  VARIANT 4, 6, 11, 13: Xaa = Any Amino Acid
CCEXYXCCNPXAXCTGCY

SEQ ID NO: 754 - protein, 18 aa, Artificial Sequence
  Synthetically generated peptide
  VARIANT 4, 6, 11, 14: Xaa = Any Amino Acid
CCEXYXCCNPXACXTGCY

SEQ ID NO: 755 - protein, 18 aa, Artificial Sequence
  Synthetically generated peptide
  VARIANT 4, 6, 11, 15: Xaa = Any Amino Acid
CCEXYXCCNPXACTXGCY

SEQ ID NO: 756 - protein, 18 aa, Artificial Sequence
  Synthetically generated peptide
  VARIANT 4, 6, 11, 16: Xaa = Any Amino Acid
CCEXYXCCNPXACTGXCY

SEQ ID NO: 757 - protein, 18 aa, Artificial Sequence
  Synthetically generated peptide
  VARIANT 4, 6, 11, 17: Xaa = Any Amino Acid
CCEXYXCCNPXACTGCXY

SEQ ID NO: 758 - protein, 17 aa, Artificial Sequence
  Synthetically generated peptide
  VARIANT 4, 6, 12: Xaa = Any Amino Acid
CCEXYXCCNPAXCTGCY

SEQ ID NO: 759 - protein, 18 aa, Artificial Sequence
  Synthetically generated peptide
  VARIANT 4, 6, 12, 13: Xaa = Any Amino Acid
CCEXYXCCNPAXXCTGCY

SEQ ID NO: 760 - protein, 18 aa, Artificial Sequence
  Synthetically generated peptide
  VARIANT 4, 6, 12, 14: Xaa = Any Amino Acid
CCEXYXCCNPAXCXTGCY

SEQ ID NO: 761 - protein, 18 aa, Artificial Sequence
  Synthetically generated peptide
  VARIANT 4, 6, 12, 15: Xaa = Any Amino Acid
CCEXYXCCNPAXCTXGCY

SEQ ID NO: 762 - protein, 18 aa, Artificial Sequence
  Synthetically generated peptide
  VARIANT 4, 6, 12, 16: Xaa = Any Amino Acid
CCEXYXCCNPAXCTGXCY

SEQ ID NO: 763 - protein, 18 aa, Artificial Sequence
  Synthetically generated peptide
  VARIANT 4, 6, 12, 17: Xaa = Any Amino Acid
CCEXYXCCNPAXCTGCXY

SEQ ID NO: 764 - protein, 17 aa, Artificial Sequence
  Synthetically generated peptide
  VARIANT 4, 6, 13: Xaa = Any Amino Acid
CCEXYXCCNPACXTGCY

SEQ ID NO: 765 - protein, 18 aa, Artificial Sequence
  Synthetically generated peptide
  VARIANT 4, 6, 13, 14: Xaa = Any Amino Acid
CCEXYXCCNPACXXTGCY

SEQ ID NO: 766 - protein, 18 aa, Artificial Sequence
  Synthetically generated peptide
  VARIANT 4, 6, 13, 15: Xaa = Any Amino Acid
CCEXYXCCNPACXTXGCY

SEQ ID NO: 767 - protein, 18 aa, Artificial Sequence
  Synthetically generated peptide
  VARIANT 4, 6, 13, 16: Xaa = Any Amino Acid
CCEXYXCCNPACXTGXCY

SEQ ID NO: 768 - protein, 18 aa, Artificial Sequence
  Synthetically generated peptide
  VARIANT 4, 6, 13, 17: Xaa = Any Amino Acid
CCEXYXCCNPACXTGCXY

SEQ ID NO: 769 - protein, 17 aa, Artificial Sequence
  Synthetically generated peptide
  VARIANT 4, 6, 14: Xaa = Any Amino Acid
CCEXYXCCNPACTXGCY

SEQ ID NO: 770 - protein, 18 aa, Artificial Sequence
  Synthetically generated peptide
  VARIANT 4, 6, 14, 15: Xaa = Any Amino Acid
CCEXYXCCNPACTXXGCY

SEQ ID NO: 771 - protein, 18 aa, Artificial Sequence
  Synthetically generated peptide
  VARIANT 4, 6, 14, 16: Xaa = Any Amino Acid
CCEXYXCCNPACTXGXCY

SEQ ID NO: 772 - protein, 18 aa, Artificial Sequence
  Synthetically generated peptide
  VARIANT 4, 6, 14, 17: Xaa = Any Amino Acid
CCEXYXCCNPACTXGCXY

SEQ ID NO: 773 - protein, 17 aa, Artificial Sequence
  Synthetically generated peptide
  VARIANT 4, 6, 15: Xaa = Any Amino Acid
CCEXYXCCNPACTGXCY

SEQ ID NO: 774 - protein, 18 aa, Artificial Sequence
  Synthetically generated peptide
  VARIANT 4, 6, 15, 16: Xaa = Any Amino Acid
CCEXYXCCNPACTGXXCY

SEQ ID NO: 775 - protein, 18 aa, Artificial Sequence
  Synthetically generated peptide
  VARIANT 4, 6, 15, 17: Xaa = Any Amino Acid
CCEXYXCCNPACTGXCXY

SEQ ID NO: 776 - protein, 17 aa, Artificial Sequence
  Synthetically generated peptide
  VARIANT 4, 6, 16: Xaa = Any Amino Acid
CCEXYXCCNPACTGCXY

SEQ ID NO: 777 - protein, 18 aa, Artificial Sequence
  Synthetically generated peptide
  VARIANT 4, 6, 16, 17: Xaa = Any Amino Acid
CCEXYXCCNPACTGCXXY

SEQ ID NO: 778 - protein, 16 aa, Artificial Sequence
  Synthetically generated peptide
  VARIANT 4, 8: Xaa = Any Amino Acid
CCEXYCCXNPACTGCY

SEQ ID NO: 779 - protein, 17 aa, Artificial Sequence
  Synthetically generated peptide
  VARIANT 4, 8, 9: Xaa = Any Amino Acid
CCEXYCCXXNPACTGCY

SEQ ID NO: 780 - protein, 18 aa, Artificial Sequence
  Synthetically generated peptide
  VARIANT 4, 8, 9, 10: Xaa = Any Amino Acid
CCEXYCCXXXNPACTGCY

SEQ ID NO: 781 - protein, 18 aa, Artificial Sequence
  Synthetically generated peptide
  VARIANT 4, 8, 9, 11: Xaa = Any Amino Acid
CCEXYCCXXNXPACTGCY

SEQ ID NO: 782 - protein, 18 aa, Artificial Sequence
  Synthetically generated peptide
  VARIANT 4, 8, 9, 12: Xaa = Any Amino Acid
CCEXYCCXXNPXACTGCY

SEQ ID NO: 783 - protein, 18 aa, Artificial Sequence
  Synthetically generated peptide
  VARIANT 4, 8, 9, 13: Xaa = Any Amino Acid
CCEXYCCXXNPAXCTGCY

SEQ ID NO: 784 - protein, 18 aa, Artificial Sequence
  Synthetically generated peptide
  VARIANT 4, 8, 9, 14: Xaa = Any Amino Acid
CCEXYCCXXNPACXTGCY

SEQ ID NO: 785 - protein, 18 aa, Artificial Sequence
  Synthetically generated peptide
  VARIANT 4, 8, 9, 15: Xaa = Any Amino Acid
CCEXYCCXXNPACTXGCY

SEQ ID NO: 786 - protein, 18 aa, Artificial Sequence
  Synthetically generated peptide
  VARIANT 4, 8, 9, 16: Xaa = Any Amino Acid
CCEXYCCXXNPACTGXCY

SEQ ID NO: 787 - protein, 18 aa, Artificial Sequence
  Synthetically generated peptide
  VARIANT 4, 8, 9, 17: Xaa = Any Amino Acid
CCEXYCCXXNPACTGCXY

SEQ ID NO: 788 - protein, 17 aa, Artificial Sequence
  Synthetically generated peptide
  VARIANT 4, 8, 10: Xaa = Any Amino Acid
CCEXYCCXNXPACTGCY

SEQ ID NO: 789 - protein, 18 aa, Artificial Sequence
  Synthetically generated peptide
  VARIANT 4, 8, 10, 11: Xaa = Any Amino Acid
CCEXYCCXNXXPACTGCY

SEQ ID NO: 790 - protein, 18 aa, Artificial Sequence
  Synthetically generated peptide
  VARIANT 4, 8, 10, 12: Xaa = Any Amino Acid
CCEXYCCXNXPXACTGCY

SEQ ID NO: 791 - protein, 18 aa, Artificial Sequence
  Synthetically generated peptide
  VARIANT 4, 8, 10, 13: Xaa = Any Amino Acid
CCEXYCCXNXPAXCTGCY

SEQ ID NO: 792 - protein, 18 aa, Artificial Sequence
  Synthetically generated peptide
  VARIANT 4, 8, 10, 14: Xaa = Any Amino Acid
CCEXYCCXNXPACXTGCY

SEQ ID NO: 793 - protein, 18 aa, Artificial Sequence
  Synthetically generated peptide
  VARIANT 4, 8, 10, 15: Xaa = Any Amino Acid
CCEXYCCXNXPACTXGCY

SEQ ID NO: 794 - protein, 18 aa, Artificial Sequence
  Synthetically generated peptide
  VARIANT 4, 8, 10, 16: Xaa = Any Amino Acid
CCEXYCCXNXPACTGXCY

SEQ ID NO: 795 - protein, 18 aa, Artificial Sequence
  Synthetically generated peptide
  VARIANT 4, 8, 10, 17: Xaa = Any Amino Acid
CCEXYCCXNXPACTGCXY

SEQ ID NO: 796 - protein, 17 aa, Artificial Sequence
  Synthetically generated peptide
  VARIANT 4, 8, 11: Xaa = Any Amino Acid
CCEXYCCXNPXACTGCY

SEQ ID NO: 797 - protein, 18 aa, Artificial Sequence
  Synthetically generated peptide
  VARIANT 4, 8, 11, 12: Xaa = Any Amino Acid
CCEXYCCXNPXXACTGCY

SEQ ID NO: 798 - protein, 18 aa, Artificial Sequence
  Synthetically generated peptide
  VARIANT 4, 8, 11, 13: Xaa = Any Amino Acid
CCEXYCCXNPXAXCTGCY

SEQ ID NO: 799 - protein, 18 aa, Artificial Sequence
  Synthetically generated peptide
  VARIANT 4, 8, 11, 14: Xaa = Any Amino Acid
CCEXYCCXNPXACXTGCY

SEQ ID NO: 800 - protein, 18 aa, Artificial Sequence
  Synthetically generated peptide
  VARIANT 4, 8, 11, 15: Xaa = Any Amino Acid
CCEXYCCXNPXACTXGCY

SEQ ID NO: 801 - protein, 18 aa, Artificial Sequence
  Synthetically generated peptide
  VARIANT 4, 8, 11, 16: Xaa = Any Amino Acid
CCEXYCCXNPXACTGXCY

SEQ ID NO: 802 - protein, 18 aa, Artificial Sequence
  Synthetically generated peptide
  VARIANT 4, 8, 11, 17: Xaa = Any Amino Acid
CCEXYCCXNPXACTGCXY

SEQ ID NO: 803 - protein, 17 aa, Artificial Sequence
  Synthetically generated peptide
  VARIANT 4, 8, 12: Xaa = Any Amino Acid
CCEXYCCXNPAXCTGCY

SEQ ID NO: 804 - protein, 18 aa, Artificial Sequence
  Synthetically generated peptide
  VARIANT 4, 8, 12, 13: Xaa = Any Amino Acid
CCEXYCCXNPAXXCTGCY

SEQ ID NO: 805 - protein, 18 aa, Artificial Sequence
  Synthetically generated peptide
  VARIANT 4, 8, 12, 14: Xaa = Any Amino Acid
CCEXYCCXNPAXCXTGCY

SEQ ID NO: 806 - protein, 18 aa, Artificial Sequence
  Synthetically generated peptide
  VARIANT 4, 8, 12, 15: Xaa = Any Amino Acid
CCEXYCCXNPAXCTXGCY

SEQ ID NO: 807 - protein, 18 aa, Artificial Sequence
  Synthetically generated peptide
  VARIANT 4, 8, 12, 16: Xaa = Any Amino Acid
CCEXYCCXNPAXCTGXCY

SEQ ID NO: 808 - protein, 18 aa, Artificial Sequence
  Synthetically generated peptide
  VARIANT 4, 8, 12, 17: Xaa = Any Amino Acid
CCEXYCCXNPAXCTGCXY

SEQ ID NO: 809 - protein, 17 aa, Artificial Sequence
  Synthetically generated peptide
  VARIANT 4, 8, 13: Xaa = Any Amino Acid
CCEXYCCXNPACXTGCY

SEQ ID NO: 810 - protein, 18 aa, Artificial Sequence
  Synthetically generated peptide
  VARIANT 4, 8, 13, 14: Xaa = Any Amino Acid
CCEXYCCXNPACXXTGCY

SEQ ID NO: 811 - protein, 18 aa, Artificial Sequence
  Synthetically generated peptide
  VARIANT 4, 8, 13, 15: Xaa = Any Amino Acid
CCEXYCCXNPACXTXGCY

SEQ ID NO: 812 - protein, 18 aa, Artificial Sequence
  Synthetically generated peptide
  VARIANT 4, 8, 13, 16: Xaa = Any Amino Acid
CCEXYCCXNPACXTGXCY

SEQ ID NO: 813 - protein, 18 aa, Artificial Sequence
  Synthetically generated peptide
  VARIANT 4, 8, 13, 17: Xaa = Any Amino Acid
CCEXYCCXNPACXTGCXY

SEQ ID NO: 814 - protein, 17 aa, Artificial Sequence
  Synthetically generated peptide
  VARIANT 4, 8, 14: Xaa = Any Amino Acid
CCEXYCCXNPACTXGCY

SEQ ID NO: 815 - protein, 18 aa, Artificial Sequence
  Synthetically generated peptide
  VARIANT 4, 8, 14, 15: Xaa = Any Amino Acid
CCEXYCCXNPACTXXGCY

SEQ ID NO: 816 - protein, 18 aa, Artificial Sequence
  Synthetically generated peptide
  VARIANT 4, 8, 14, 16: Xaa = Any Amino Acid
CCEXYCCXNPACTXGXCY

SEQ ID NO: 817 - protein, 18 aa, Artificial Sequence
  Synthetically generated peptide
  VARIANT 4, 8, 14, 17: Xaa = Any Amino Acid
CCEXYCCXNPACTXGCXY

SEQ ID NO: 818 - protein, 17 aa, Artificial Sequence
  Synthetically generated peptide
  VARIANT 4, 8, 15: Xaa = Any Amino Acid
CCEXYCCXNPACTGXCY

SEQ ID NO: 819 - protein, 18 aa, Artificial Sequence
  Synthetically generated peptide
  VARIANT 4, 8, 15, 16: Xaa = Any Amino Acid
CCEXYCCXNPACTGXXCY

SEQ ID NO: 820 - protein, 18 aa, Artificial Sequence
  Synthetically generated peptide
  VARIANT 4, 8, 15, 17: Xaa = Any Amino Acid
CCEXYCCXNPACTGXCXY

SEQ ID NO: 821 - protein, 17 aa, Artificial Sequence
  Synthetically generated peptide
  VARIANT 4, 8, 16: Xaa = Any Amino Acid
CCEXYCCXNPACTGCXY

SEQ ID NO: 822 - protein, 18 aa, Artificial Sequence
  Synthetically generated peptide
  VARIANT 4, 8, 16, 17: Xaa = Any Amino Acid
CCEXYCCXNPACTGCXXY

SEQ ID NO: 823 - protein, 16 aa, Artificial Sequence
  Synthetically generated peptide
  VARIANT 4, 9: Xaa = Any Amino Acid
CCEXYCCNXPACTGCY

SEQ ID NO: 824 - protein, 17 aa, Artificial Sequence
  Synthetically generated peptide
  VARIANT 4, 9, 10: Xaa = Any Amino Acid
CCEXYCCNXXPACTGCY

SEQ ID NO: 825 - protein, 18 aa, Artificial Sequence
  Synthetically generated peptide
  VARIANT 4, 9, 10, 11: Xaa = Any Amino Acid
CCEXYCCNXXXPACTGCY

SEQ ID NO: 826 - protein, 18 aa, Artificial Sequence
  Synthetically generated peptide
  VARIANT 4, 9, 10, 12: Xaa = Any Amino Acid
CCEXYCCNXXPXACTGCY

SEQ ID NO: 827 - protein, 18 aa, Artificial Sequence
  Synthetically generated peptide
  VARIANT 4, 9, 10, 13: Xaa = Any Amino Acid
CCEXYCCNXXPAXCTGCY

SEQ ID NO: 828 - protein, 18 aa, Artificial Sequence
  Synthetically generated peptide
  VARIANT 4, 9, 10, 14: Xaa = Any Amino Acid
CCEXYCCNXXPACXTGCY

SEQ ID NO: 829 - protein, 18 aa, Artificial Sequence
  Synthetically generated peptide
  VARIANT 4, 9, 10, 15: Xaa = Any Amino Acid
CCEXYCCNXXPACTXGCY

SEQ ID NO: 830 - protein, 18 aa, Artificial Sequence
  Synthetically generated peptide
  VARIANT 4, 9, 10, 16: Xaa = Any Amino Acid
CCEXYCCNXXPACTGXCY

SEQ ID NO: 831 - protein, 18 aa, Artificial Sequence
  Synthetically generated peptide
  VARIANT 4, 9, 10, 17: Xaa = Any Amino Acid
CCEXYCCNXXPACTGCXY

SEQ ID NO: 832 - protein, 17 aa, Artificial Sequence
  Synthetically generated peptide
  VARIANT 4, 9, 11: Xaa = Any Amino Acid
CCEXYCCNXPXACTGCY

SEQ ID NO: 833 - protein, 18 aa, Artificial Sequence
  Synthetically generated peptide
  VARIANT 4, 9, 11, 12: Xaa = Any Amino Acid
CCEXYCCNXPXXACTGCY

SEQ ID NO: 834 - protein, 18 aa, Artificial Sequence
  Synthetically generated peptide
  VARIANT 4, 9, 11, 13: Xaa = Any Amino Acid
CCEXYCCNXPXAXCTGCY

SEQ ID NO: 835 - protein, 18 aa, Artificial Sequence
  Synthetically generated peptide
  VARIANT 4, 9, 11, 14: Xaa = Any Amino Acid
CCEXYCCNXPXACXTGCY

SEQ ID NO: 836 - protein, 18 aa, Artificial Sequence
  Synthetically generated peptide
  VARIANT 4, 9, 11, 15: Xaa = Any Amino Acid
CCEXYCCNXPXACTXGCY

SEQ ID NO: 837 - protein, 18 aa, Artificial Sequence
  Synthetically generated peptide
  VARIANT 4, 9, 11, 16: Xaa = Any Amino Acid
CCEXYCCNXPXACTGXCY

SEQ ID NO: 838 - protein, 18 aa, Artificial Sequence
  Synthetically generated peptide
  VARIANT 4, 9, 11, 17: Xaa = Any Amino Acid
CCEXYCCNXPXACTGCXY

SEQ ID NO: 839 - protein, 17 aa, Artificial Sequence
  Synthetically generated peptide
  VARIANT 4, 9, 12: Xaa = Any Amino Acid
CCEXYCCNXPAXCTGCY

SEQ ID NO: 840 - protein, 18 aa, Artificial Sequence
  Synthetically generated peptide
  VARIANT 4, 9, 12, 13: Xaa = Any Amino Acid
CCEXYCCNXPAXXCTGCY

SEQ ID NO: 841 - protein, 18 aa, Artificial Sequence
  Synthetically generated peptide
  VARIANT 4, 9, 12, 14: Xaa = Any Amino Acid
CCEXYCCNXPAXCXTGCY

SEQ ID NO: 842 - protein, 18 aa, Artificial Sequence
  Synthetically generated peptide
  VARIANT 4, 9, 12, 15: Xaa = Any Amino Acid
CCEXYCCNXPAXCTXGCY

SEQ ID NO: 843 - protein, 18 aa, Artificial Sequence
  Synthetically generated peptide
  VARIANT 4, 9, 12, 16: Xaa = Any Amino Acid
CCEXYCCNXPAXCTGXCY

SEQ ID NO: 844 - protein, 18 aa, Artificial Sequence
  Synthetically generated peptide
  VARIANT 4, 9, 12, 17: Xaa = Any Amino Acid
CCEXYCCNXPAXCTGCXY

SEQ ID NO: 845 - protein, 17 aa, Artificial Sequence
  Synthetically generated peptide
  VARIANT 4, 9, 13: Xaa = Any Amino Acid
CCEXYCCNXPACXTGCY

SEQ ID NO: 846 - protein, 18 aa, Artificial Sequence
  Synthetically generated peptide
  VARIANT 4, 9, 13, 14: Xaa = Any Amino Acid
CCEXYCCNXPACXXTGCY

SEQ ID NO: 847 - protein, 18 aa, Artificial Sequence
  Synthetically generated peptide
  VARIANT 4, 9, 13, 15: Xaa = Any Amino Acid
CCEXYCCNXPACXTXGCY

SEQ ID NO: 848 - protein, 18 aa, Artificial Sequence
  Synthetically generated peptide
  VARIANT 4, 9, 13, 16: Xaa = Any Amino Acid
CCEXYCCNXPACXTGXCY

SEQ ID NO: 849 - protein, 18 aa, Artificial Sequence
  Synthetically generated peptide
  VARIANT 4, 9, 13, 17: Xaa = Any Amino Acid
CCEXYCCNXPACXTGCXY

SEQ ID NO: 850 - protein, 17 aa, Artificial Sequence
  Synthetically generated peptide
  VARIANT 4, 9, 14: Xaa = Any Amino Acid
CCEXYCCNXPACTXGCY

SEQ ID NO: 851 - protein, 18 aa, Artificial Sequence
  Synthetically generated peptide
  VARIANT 4, 9, 14, 15: Xaa = Any Amino Acid
CCEXYCCNXPACTXXGCY

SEQ ID NO: 852 - protein, 18 aa, Artificial Sequence
  Synthetically generated peptide
  VARIANT 4, 9, 14, 16: Xaa = Any Amino Acid
CCEXYCCNXPACTXGXCY

SEQ ID NO: 853 - protein, 18 aa, Artificial Sequence
  Synthetically generated peptide
  VARIANT 4, 9, 14, 17: Xaa = Any Amino Acid
CCEXYCCNXPACTXGCXY

SEQ ID NO: 854 - protein, 17 aa, Artificial Sequence
  Synthetically generated peptide
  VARIANT 4, 9, 15: Xaa = Any Amino Acid
CCEXYCCNXPACTGXCY

SEQ ID NO: 855 - protein, 18 aa, Artificial Sequence
  Synthetically generated peptide
  VARIANT 4, 9, 15, 16: Xaa = Any Amino Acid
CCEXYCCNXPACTGXXCY

SEQ ID NO: 856 - protein, 18 aa, Artificial Sequence
  Synthetically generated peptide
  VARIANT 4, 9, 15, 17: Xaa = Any Amino Acid
CCEXYCCNXPACTGXCXY

SEQ ID NO: 857 - protein, 17 aa, Artificial Sequence
  Synthetically generated peptide
  VARIANT 4, 9, 16: Xaa = Any Amino Acid
CCEXYCCNXPACTGCXY

SEQ ID NO: 858 - protein, 18 aa, Artificial Sequence
  Synthetically generated peptide
  VARIANT 4, 9, 16, 17: Xaa = Any Amino Acid
CCEXYCCNXPACTGCXXY

SEQ ID NO: 859 - protein, 16 aa, Artificial Sequence
  Synthetically generated peptide
  VARIANT 4, 10: Xaa = Any Amino Acid
CCEXYCCNPXACTGCY

SEQ ID NO: 860 - protein, 17 aa, Artificial Sequence
  Synthetically generated peptide
  VARIANT 4, 10, 11: Xaa = Any Amino Acid
CCEXYCCNPXXACTGCY

SEQ ID NO: 861 - protein, 18 aa, Artificial Sequence
  Synthetically generated peptide
  VARIANT 4, 10, 11, 12: Xaa = Any Amino Acid
CCEXYCCNPXXXACTGCY

SEQ ID NO: 862 - protein, 18 aa, Artificial Sequence
  Synthetically generated peptide
  VARIANT 4, 10, 11, 13: Xaa = Any Amino Acid
CCEXYCCNPXXAXCTGCY

SEQ ID NO: 863 - protein, 18 aa, Artificial Sequence
  Synthetically generated peptide
  VARIANT 4, 10, 11, 14: Xaa = Any Amino Acid
CCEXYCCNPXXACXTGCY

SEQ ID NO: 864 - protein, 18 aa, Artificial Sequence
  Synthetically generated peptide
  VARIANT 4, 10, 11, 15: Xaa = Any Amino Acid
CCEXYCCNPXXACTXGCY

SEQ ID NO: 865 - protein, 18 aa, Artificial Sequence
  Synthetically generated peptide
  VARIANT 4, 10, 11, 16: Xaa = Any Amino Acid
CCEXYCCNPXXACTGXCY

SEQ ID NO: 866 - protein, 18 aa, Artificial Sequence
  Synthetically generated peptide
  VARIANT 4, 10, 11, 17: Xaa = Any Amino Acid
CCEXYCCNPXXACTGCXY

SEQ ID NO: 867 - protein, 17 aa, Artificial Sequence
  Synthetically generated peptide
  VARIANT 4, 10, 12: Xaa = Any Amino Acid
CCEXYCCNPXAXCTGCY

SEQ ID NO: 868 - protein, 18 aa, Artificial Sequence
  Synthetically generated peptide
  VARIANT 4, 10, 12, 13: Xaa = Any Amino Acid
CCEXYCCNPXAXXCTGCY

SEQ ID NO: 869 - protein, 18 aa, Artificial Sequence
  Synthetically generated peptide
  VARIANT 4, 10, 12, 14: Xaa = Any Amino Acid
CCEXYCCNPXAXCXTGCY

SEQ ID NO: 870 - protein, 18 aa, Artificial Sequence
  Synthetically generated peptide
  VARIANT 4, 10, 12, 15: Xaa = Any Amino Acid
CCEXYCCNPXAXCTXGCY

SEQ ID NO: 871 - protein, 18 aa, Artificial Sequence
  Synthetically generated peptide
  VARIANT 4, 10, 12, 16: Xaa = Any Amino Acid
CCEXYCCNPXAXCTGXCY

SEQ ID NO: 872 - protein, 18 aa, Artificial Sequence
  Synthetically generated peptide
  VARIANT 4, 10, 12, 17: Xaa = Any Amino Acid
CCEXYCCNPXAXCTGCXY

SEQ ID NO: 873 - protein, 17 aa, Artificial Sequence
  Synthetically generated peptide
  VARIANT 4, 10, 13: Xaa = Any Amino Acid
CCEXYCCNPXACXTGCY

SEQ ID NO: 874 - protein, 18 aa, Artificial Sequence
  Synthetically generated peptide
  VARIANT 4, 10, 13, 14: Xaa = Any Amino Acid
CCEXYCCNPXACXXTGCY

SEQ ID NO: 875 - protein, 18 aa, Artificial Sequence
  Synthetically generated peptide
  VARIANT 4, 10, 13, 15: Xaa = Any Amino Acid
CCEXYCCNPXACXTXGCY

SEQ ID NO: 876 - protein, 18 aa, Artificial Sequence
  Synthetically generated peptide
  VARIANT 4, 10, 13, 16: Xaa = Any Amino Acid
CCEXYCCNPXACXTGXCY

SEQ ID NO: 877 - protein, 18 aa, Artificial Sequence
  Synthetically generated peptide
  VARIANT 4, 10, 13, 17: Xaa = Any Amino Acid
CCEXYCCNPXACXTGCXY

SEQ ID NO: 878 - protein, 17 aa, Artificial Sequence
  Synthetically generated peptide
  VARIANT 4, 10, 14: Xaa = Any Amino Acid
CCEXYCCNPXACTXGCY

SEQ ID NO: 879 - protein, 18 aa, Artificial Sequence
  Synthetically generated peptide
  VARIANT 4, 10, 14, 15: Xaa = Any Amino Acid
CCEXYCCNPXACTXXGCY

SEQ ID NO: 880 - protein, 18 aa, Artificial Sequence
  Synthetically generated peptide
  VARIANT 4, 10, 14, 16: Xaa = Any Amino Acid
CCEXYCCNPXACTXGXCY

SEQ ID NO: 881 - protein, 18 aa, Artificial Sequence
  Synthetically generated peptide
  VARIANT 4, 10, 14, 17: Xaa = Any Amino Acid
CCEXYCCNPXACTXGCXY

SEQ ID NO: 882 - protein, 17 aa, Artificial Sequence
  Synthetically generated peptide
  VARIANT 4, 10, 15: Xaa = Any Amino Acid
CCEXYCCNPXACTGXCY

SEQ ID NO: 883 - protein, 18 aa, Artificial Sequence
  Synthetically generated peptide
  VARIANT 4, 10, 15, 16: Xaa = Any Amino Acid
CCEXYCCNPXACTGXXCY

SEQ ID NO: 884 - protein, 18 aa, Artificial Sequence
  Synthetically generated peptide
  VARIANT 4, 10, 15, 17: Xaa = Any Amino Acid
CCEXYCCNPXACTGXCXY

SEQ ID NO: 885 - protein, 17 aa, Artificial Sequence
  Synthetically generated peptide
  VARIANT 4, 10, 16: Xaa = Any Amino Acid
CCEXYCCNPXACTGCXY

SEQ ID NO: 886 - protein, 18 aa, Artificial Sequence
  Synthetically generated peptide
  VARIANT 4, 10, 16, 17: Xaa = Any Amino Acid
CCEXYCCNPXACTGCXXY

SEQ ID NO: 887 - protein, 16 aa, Artificial Sequence
  Synthetically generated peptide
  VARIANT 4, 11: Xaa = Any Amino Acid
CCEXYCCNPAXCTGCY

SEQ ID NO: 888 - protein, 17 aa, Artificial Sequence
  Synthetically generated peptide
  VARIANT 4, 11, 12: Xaa = Any Amino Acid
CCEXYCCNPAXXCTGCY

SEQ ID NO: 889 - protein, 18 aa, Artificial Sequence
  Synthetically generated peptide
  VARIANT 4, 11, 12, 13: Xaa = Any Amino Acid
CCEXYCCNPAXXXCTGCY

SEQ ID NO: 890 - protein, 18 aa, Artificial Sequence
  Synthetically generated peptide
  VARIANT 4, 11, 12, 14: Xaa = Any Amino Acid
CCEXYCCNPAXXCXTGCY

SEQ ID NO: 891 - protein, 18 aa, Artificial Sequence
  Synthetically generated peptide
  VARIANT 4, 11, 12, 15: Xaa = Any Amino Acid
CCEXYCCNPAXXCTXGCY

SEQ ID NO: 892 - protein, 18 aa, Artificial Sequence
  Synthetically generated peptide
  VARIANT 4, 11, 12, 16: Xaa = Any Amino Acid
CCEXYCCNPAXXCTGXCY

SEQ ID NO: 893 - protein, 18 aa, Artificial Sequence
  Synthetically generated peptide
  VARIANT 4, 11, 12, 17: Xaa = Any Amino Acid
CCEXYCCNPAXXCTGCXY

SEQ ID NO: 894 - protein, 17 aa, Artificial Sequence
  Synthetically generated peptide
  VARIANT 4, 11, 13: Xaa = Any Amino Acid
CCEXYCCNPAXCXTGCY

SEQ ID NO: 895 - protein, 18 aa, Artificial Sequence
  Synthetically generated peptide
  VARIANT 4, 11, 13, 14: Xaa = Any Amino Acid
CCEXYCCNPAXCXXTGCY

SEQ ID NO: 896 - protein, 18 aa, Artificial Sequence
  Synthetically generated peptide
  VARIANT 4, 11, 13, 15: Xaa = Any Amino Acid
CCEXYCCNPAXCXTXGCY

SEQ ID NO: 897 - protein, 18 aa, Artificial Sequence
  Synthetically generated peptide
  VARIANT 4, 11, 13, 16: Xaa = Any Amino Acid
CCEXYCCNPAXCXTGXCY

SEQ ID NO: 898 - protein, 18 aa, Artificial Sequence
  Synthetically generated peptide
  VARIANT 4, 11, 13, 17: Xaa = Any Amino Acid
CCEXYCCNPAXCXTGCXY

SEQ ID NO: 899 - protein, 17 aa, Artificial Sequence
  Synthetically generated peptide
  VARIANT 4, 11, 14: Xaa = Any Amino Acid
CCEXYCCNPAXCTXGCY

SEQ ID NO: 900 - protein, 18 aa, Artificial Sequence
  Synthetically generated peptide
  VARIANT 4, 11, 14, 15: Xaa = Any Amino Acid
CCEXYCCNPAXCTXXGCY

SEQ ID NO: 901 - protein, 18 aa, Artificial Sequence
  Synthetically generated peptide
  VARIANT 4, 11, 14, 16: Xaa = Any Amino Acid
CCEXYCCNPAXCTXGXCY

SEQ ID NO: 902 - protein, 18 aa, Artificial Sequence
  Synthetically generated peptide
  VARIANT 4, 11, 14, 17: Xaa = Any Amino Acid
CCEXYCCNPAXCTXGCXY

SEQ ID NO: 903 - protein, 17 aa, Artificial Sequence
  Synthetically generated peptide
  VARIANT 4, 11, 15: Xaa = Any Amino Acid
CCEXYCCNPAXCTGXCY

SEQ ID NO: 904 - protein, 18 aa, Artificial Sequence
  Synthetically generated peptide
  VARIANT 4, 11, 15, 16: Xaa = Any Amino Acid
CCEXYCCNPAXCTGXXCY

SEQ ID NO: 905 - protein, 18 aa, Artificial Sequence
  Synthetically generated peptide
  VARIANT 4, 11, 15, 17: Xaa = Any Amino Acid
CCEXYCCNPAXCTGXCXY

SEQ ID NO: 906 - protein, 17 aa, Artificial Sequence
  Synthetically generated peptide
  VARIANT 4, 11, 16: Xaa = Any Amino Acid
CCEXYCCNPAXCTGCXY

SEQ ID NO: 907 - protein, 18 aa, Artificial Sequence
  Synthetically generated peptide
  VARIANT 4, 11, 16, 17: Xaa = Any Amino Acid
CCEXYCCNPAXCTGCXXY

SEQ ID NO: 908 - protein, 16 aa, Artificial Sequence
  Synthetically generated peptide
  VARIANT 4, 12: Xaa = Any Amino Acid
CCEXYCCNPACXTGCY

SEQ ID NO: 909 - protein, 17 aa, Artificial Sequence
  Synthetically generated peptide
  VARIANT 4, 12, 13: Xaa = Any Amino Acid
CCEXYCCNPACXXTGCY

SEQ ID NO: 910 - protein, 18 aa, Artificial Sequence
  Synthetically generated peptide
  VARIANT 4, 12, 13, 14: Xaa = Any Amino Acid
CCEXYCCNPACXXXTGCY

SEQ ID NO: 911 - protein, 18 aa, Artificial Sequence
  Synthetically generated peptide
  VARIANT 4, 12, 13, 15: Xaa = Any Amino Acid
CCEXYCCNPACXXTXGCY

SEQ ID NO: 912 - protein, 18 aa, Artificial Sequence
  Synthetically generated peptide
  VARIANT 4, 12, 13, 16: Xaa = Any Amino Acid
CCEXYCCNPACXXTGXCY

SEQ ID NO: 913 - protein, 18 aa, Artificial Sequence
  Synthetically generated peptide
  VARIANT 4, 12, 13, 17: Xaa = Any Amino Acid
CCEXYCCNPACXXTGCXY

SEQ ID NO: 914 - protein, 17 aa, Artificial Sequence
  Synthetically generated peptide
  VARIANT 4, 12, 14: Xaa = Any Amino Acid
CCEXYCCNPACXTXGCY

SEQ ID NO: 915 - protein, 18 aa, Artificial Sequence
  Synthetically generated peptide
  VARIANT 4, 12, 14, 15: Xaa = Any Amino Acid
CCEXYCCNPACXTXXGCY

SEQ ID NO: 916 - protein, 18 aa, Artificial Sequence
  Synthetically generated peptide
  VARIANT 4, 12, 14, 16: Xaa = Any Amino Acid
CCEXYCCNPACXTXGXCY

SEQ ID NO: 917 - protein, 18 aa, Artificial Sequence
  Synthetically generated peptide
  VARIANT 4, 12, 14, 17: Xaa = Any Amino Acid
CCEXYCCNPACXTXGCXY

SEQ ID NO: 918 - protein, 17 aa, Artificial Sequence
  Synthetically generated peptide
  VARIANT 4, 12, 15: Xaa = Any Amino Acid
CCEXYCCNPACXTGXCY

SEQ ID NO: 919 - protein, 18 aa, Artificial Sequence
  Synthetically generated peptide
  VARIANT 4, 12, 15, 16: Xaa = Any Amino Acid
CCEXYCCNPACXTGXXCY

SEQ ID NO: 920 - protein, 18 aa, Artificial Sequence
  Synthetically generated peptide
  VARIANT 4, 12, 15, 17: Xaa = Any Amino Acid
CCEXYCCNPACXTGXCXY

SEQ ID NO: 921 - protein, 17 aa, Artificial Sequence
  Synthetically generated peptide
  VARIANT 4, 12, 16: Xaa = Any Amino Acid
CCEXYCCNPACXTGCXY

SEQ ID NO: 922 - protein, 18 aa, Artificial Sequence
  Synthetically generated peptide
  VARIANT 4, 12, 16, 17: Xaa = Any Amino Acid
CCEXYCCNPACXTGCXXY

SEQ ID NO: 923 - protein, 16 aa, Artificial Sequence
  Synthetically generated peptide
  VARIANT 4, 13: Xaa = Any Amino Acid
CCEXYCCNPACTXGCY

SEQ ID NO: 924 - protein, 17 aa, Artificial Sequence
  Synthetically generated peptide
  VARIANT 4, 13, 14: Xaa = Any Amino Acid
CCEXYCCNPACTXXGCY

SEQ ID NO: 925 - protein, 18 aa, Artificial Sequence
  Synthetically generated peptide
  VARIANT 4, 13, 14, 15: Xaa = Any Amino Acid
CCEXYCCNPACTXXXGCY

SEQ ID NO: 926 - protein, 18 aa, Artificial Sequence
  Synthetically generated peptide
  VARIANT 4, 13, 14, 16: Xaa = Any Amino Acid
CCEXYCCNPACTXXGXCY

SEQ ID NO: 927 - protein, 18 aa, Artificial Sequence
  Synthetically generated peptide
  VARIANT 4, 13, 14, 17: Xaa = Any Amino Acid
CCEXYCCNPACTXXGCXY

SEQ ID NO: 928 - protein, 17 aa, Artificial Sequence
  Synthetically generated peptide
  VARIANT 4, 13, 15: Xaa = Any Amino Acid
CCEXYCCNPACTXGXCY

SEQ ID NO: 929 - protein, 18 aa, Artificial Sequence
  Synthetically generated peptide
  VARIANT 4, 13, 15, 16: Xaa = Any Amino Acid
CCEXYCCNPACTXGXXCY

SEQ ID NO: 930 - protein, 18 aa, Artificial Sequence
  Synthetically generated peptide
  VARIANT 4, 13, 15, 17: Xaa = Any Amino Acid
CCEXYCCNPACTXGXCXY

SEQ ID NO: 931 - protein, 17 aa, Artificial Sequence
  Synthetically generated peptide
  VARIANT 4, 13, 16: Xaa = Any Amino Acid
CCEXYCCNPACTXGCXY

SEQ ID NO: 932 - protein, 18 aa, Artificial Sequence
  Synthetically generated peptide
  VARIANT 4, 13, 16, 17: Xaa = Any Amino Acid
CCEXYCCNPACTXGCXXY

SEQ ID NO: 933 - protein, 16 aa, Artificial Sequence
  Synthetically generated peptide
  VARIANT 4, 14: Xaa = Any Amino Acid
CCEXYCCNPACTGXCY

SEQ ID NO: 934 - protein, 17 aa, Artificial Sequence
  Synthetically generated peptide
  VARIANT 4, 14, 15: Xaa = Any Amino Acid
CCEXYCCNPACTGXXCY

SEQ ID NO: 935 - protein, 18 aa, Artificial Sequence
  Synthetically generated peptide
  VARIANT 4, 14, 15, 16: Xaa = Any Amino Acid
CCEXYCCNPACTGXXXCY

SEQ ID NO: 936 - protein, 18 aa, Artificial Sequence
  Synthetically generated peptide
  VARIANT 4, 14, 15, 17: Xaa = Any Amino Acid
CCEXYCCNPACTGXXCXY

SEQ ID NO: 937 - protein, 17 aa, Artificial Sequence
  Synthetically generated peptide
  VARIANT 4, 14, 16: Xaa = Any Amino Acid
CCEXYCCNPACTGXCXY

SEQ ID NO: 938 - protein, 18 aa, Artificial Sequence
  Synthetically generated peptide
  VARIANT 4, 14, 16, 17: Xaa = Any Amino Acid
CCEXYCCNPACTGXCXXY

SEQ ID NO: 939 - protein, 16 aa, Artificial Sequence
  Synthetically generated peptide
  VARIANT 4, 15: Xaa = Any Amino Acid
CCEXYCCNPACTGCXY

SEQ ID NO: 940 - protein, 17 aa, Artificial Sequence
  Synthetically generated peptide
  VARIANT 4, 15, 16: Xaa = Any Amino Acid
CCEXYCCNPACTGCXXY

SEQ ID NO: 941 - protein, 18 aa, Artificial Sequence
  Synthetically generated peptide
  VARIANT 4, 15, 16, 17: Xaa = Any Amino Acid
CCEXYCCNPACTGCXXXY

SEQ ID NO: 942 - protein, 15 aa, Artificial Sequence
  Synthetically generated peptide
  VARIANT 5: Xaa = Any Amino Acid
CCEYXCCNPACTGCY

SEQ ID NO: 943 - protein, 16 aa, Artificial Sequence
  Synthetically generated peptide
  VARIANT 5, 6: Xaa = Any Amino Acid
CCEYXXCCNPACTGCY

SEQ ID NO: 944 - protein, 17 aa, Artificial Sequence
  Synthetically generated peptide
  VARIANT 5, 6, 7: Xaa = Any Amino Acid
CCEYXXXCCNPACTGCY

SEQ ID NO: 945 - protein, 18 aa, Artificial Sequence
  Synthetically generated peptide
  VARIANT 5, 6, 7, 8: Xaa = Any Amino Acid
CCEYXXXXCCNPACTGCY

SEQ ID NO: 946 - protein, 18 aa, Artificial Sequence
  Synthetically generated peptide
  VARIANT 5, 6, 7, 10: Xaa = Any Amino Acid
CCEYXXXCCXNPACTGCY

SEQ ID NO: 947 - protein, 18 aa, Artificial Sequence
  Synthetically generated peptide
  VARIANT 5, 6, 7, 11: Xaa = Any Amino Acid
CCEYXXXCCNXPACTGCY

SEQ ID NO: 948 - protein, 18 aa, Artificial Sequence
  Synthetically generated peptide
  VARIANT 5, 6, 7, 12: Xaa = Any Amino Acid
CCEYXXXCCNPXACTGCY

SEQ ID NO: 949 - protein, 18 aa, Artificial Sequence
  Synthetically generated peptide
  VARIANT 5, 6, 7, 13: Xaa = Any Amino Acid
CCEYXXXCCNPAXCTGCY

SEQ ID NO: 950 - protein, 18 aa, Artificial Sequence
  Synthetically generated peptide
  VARIANT 5, 6, 7, 14: Xaa = Any Amino Acid
CCEYXXXCCNPACXTGCY

SEQ ID NO: 951 - protein, 18 aa, Artificial Sequence
  Synthetically generated peptide
  VARIANT 5, 6, 7, 15: Xaa = Any Amino Acid
CCEYXXXCCNPACTXGCY

SEQ ID NO: 952 - protein, 18 aa, Artificial Sequence
  Synthetically generated peptide
  VARIANT 5, 6, 7, 16: Xaa = Any Amino Acid
CCEYXXXCCNPACTGXCY

SEQ ID NO: 953 - protein, 18 aa, Artificial Sequence
  Synthetically generated peptide
  VARIANT 5, 6, 7, 17: Xaa = Any Amino Acid
CCEYXXXCCNPACTGCXY

SEQ ID NO: 954 - protein, 17 aa, Artificial Sequence
  Synthetically generated peptide
  VARIANT 5, 6, 9: Xaa = Any Amino Acid
CCEYXXCCXNPACTGCY

SEQ ID NO: 955 - protein, 18 aa, Artificial Sequence
  Synthetically generated peptide
  VARIANT 5, 6, 9, 10: Xaa = Any Amino Acid
CCEYXXCCXXNPACTGCY

SEQ ID NO: 956 - protein, 18 aa, Artificial Sequence
  Synthetically generated peptide
  VARIANT 5, 6, 9, 11: Xaa = Any Amino Acid
CCEYXXCCXNXPACTGCY

SEQ ID NO: 957 - protein, 18 aa, Artificial Sequence
  Synthetically generated peptide
  VARIANT 5, 6, 9, 12: Xaa = Any Amino Acid
CCEYXXCCXNPXACTGCY

SEQ ID NO: 958 - protein, 18 aa, Artificial Sequence
  Synthetically generated peptide
  VARIANT 5, 6, 9, 13: Xaa = Any Amino Acid
CCEYXXCCXNPAXCTGCY

SEQ ID NO: 959 - protein, 18 aa, Artificial Sequence
  Synthetically generated peptide
  VARIANT 5, 6, 9, 14: Xaa = Any Amino Acid
CCEYXXCCXNPACXTGCY

SEQ ID NO: 960 - protein, 18 aa, Artificial Sequence
  Synthetically generated peptide
  VARIANT 5, 6, 9, 15: Xaa = Any Amino Acid
CCEYXXCCXNPACTXGCY

SEQ ID NO: 961 - protein, 18 aa, Artificial Sequence
  Synthetically generated peptide
  VARIANT 5, 6, 9, 16: Xaa = Any Amino Acid
CCEYXXCCXNPACTGXCY

SEQ ID NO: 962 - protein, 18 aa, Artificial Sequence
  Synthetically generated peptide
  VARIANT 5, 6, 9, 17: Xaa = Any Amino Acid
CCEYXXCCXNPACTGCXY

SEQ ID NO: 963 - protein, 17 aa, Artificial Sequence
  Synthetically generated peptide
  VARIANT 5, 6, 10: Xaa = Any Amino Acid
CCEYXXCCNXPACTGCY

SEQ ID NO: 964 - protein, 18 aa, Artificial Sequence
  Synthetically generated peptide
  VARIANT 5, 6, 10, 11: Xaa = Any Amino Acid
CCEYXXCCNXXPACTGCY

SEQ ID NO: 965 - protein, 18 aa, Artificial Sequence
  Synthetically generated peptide
  VARIANT 5, 6, 10, 12: Xaa = Any Amino Acid
CCEYXXCCNXPXACTGCY

SEQ ID NO: 966 - protein, 18 aa, Artificial Sequence
  Synthetically generated peptide
  VARIANT 5, 6, 10, 13: Xaa = Any Amino Acid
CCEYXXCCNXPAXCTGCY

SEQ ID NO: 967 - protein, 18 aa, Artificial Sequence
  Synthetically generated peptide
  VARIANT 5, 6, 10, 14: Xaa = Any Amino Acid
CCEYXXCCNXPACXTGCY

SEQ ID NO: 968 - protein, 18 aa, Artificial Sequence
  Synthetically generated peptide
  VARIANT 5, 6, 10, 15: Xaa = Any Amino Acid
CCEYXXCCNXPACTXGCY

SEQ ID NO: 969 - protein, 18 aa, Artificial Sequence
  Synthetically generated peptide
  VARIANT 5, 6, 10, 16: Xaa = Any Amino Acid
CCEYXXCCNXPACTGXCY

SEQ ID NO: 970 - protein, 18 aa, Artificial Sequence
  Synthetically generated peptide
  VARIANT 5, 6, 10, 17: Xaa = Any Amino Acid
CCEYXXCCNXPACTGCXY

SEQ ID NO: 971 - protein, 17 aa, Artificial Sequence
  Synthetically generated peptide
  VARIANT 5, 6, 11: Xaa = Any Amino Acid
CCEYXXCCNPXACTGCY

SEQ ID NO: 972 - protein, 18 aa, Artificial Sequence
  Synthetically generated peptide
  VARIANT 5, 6, 11, 12: Xaa = Any Amino Acid
CCEYXXCCNPXXACTGCY

SEQ ID NO: 973 - protein, 18 aa, Artificial Sequence
  Synthetically generated peptide
  VARIANT 5, 6, 11, 13: Xaa = Any Amino Acid
CCEYXXCCNPXAXCTGCY

SEQ ID NO: 974 - protein, 18 aa, Artificial Sequence
  Synthetically generated peptide
  VARIANT 5, 6, 11, 14: Xaa = Any Amino Acid
CCEYXXCCNPXACXTGCY

SEQ ID NO: 975 - protein, 18 aa, Artificial Sequence
  Synthetically generated peptide
  VARIANT 5, 6, 11, 15: Xaa = Any Amino Acid
CCEYXXCCNPXACTXGCY

SEQ ID NO: 976 - protein, 18 aa, Artificial Sequence
  Synthetically generated peptide
  VARIANT 5, 6, 11, 16: Xaa = Any Amino Acid
CCEYXXCCNPXACTGXCY

SEQ ID NO: 977 - protein, 18 aa, Artificial Sequence
  Synthetically generated peptide
  VARIANT 5, 6, 11, 17: Xaa = Any Amino Acid
CCEYXXCCNPXACTGCXY

SEQ ID NO: 978 - protein, 17 aa, Artificial Sequence
  Synthetically generated peptide
  VARIANT 5, 6, 12: Xaa = Any Amino Acid
CCEYXXCCNPAXCTGCY

SEQ ID NO: 979 - protein, 18 aa, Artificial Sequence
  Synthetically generated peptide
  VARIANT 5, 6, 12, 13: Xaa = Any Amino Acid
CCEYXXCCNPAXXCTGCY

SEQ ID NO: 980 - protein, 18 aa, Artificial Sequence
  Synthetically generated peptide
  VARIANT 5, 6, 12, 14: Xaa = Any Amino Acid
CCEYXXCCNPAXCXTGCY

SEQ ID NO: 981 - protein, 18 aa, Artificial Sequence
  Synthetically generated peptide
  VARIANT 5, 6, 12, 15: Xaa = Any Amino Acid
CCEYXXCCNPAXCTXGCY

SEQ ID NO: 982 - protein, 18 aa, Artificial Sequence
  Synthetically generated peptide
  VARIANT 5, 6, 12, 16: Xaa = Any Amino Acid
CCEYXXCCNPAXCTGXCY

SEQ ID NO: 983 - protein, 18 aa, Artificial Sequence
  Synthetically generated peptide
  VARIANT 5, 6, 12, 17: Xaa = Any Amino Acid
CCEYXXCCNPAXCTGCXY

SEQ ID NO: 984 - protein, 17 aa, Artificial Sequence
  Synthetically generated peptide
  VARIANT 5, 6, 13: Xaa = Any Amino Acid
CCEYXXCCNPACXTGCY

SEQ ID NO: 985 - protein, 18 aa, Artificial Sequence
  Synthetically generated peptide
  VARIANT 5, 6, 13, 14: Xaa = Any Amino Acid
CCEYXXCCNPACXXTGCY

SEQ ID NO: 986 - protein, 18 aa, Artificial Sequence
  Synthetically generated peptide
  VARIANT 5, 6, 13, 15: Xaa = Any Amino Acid
CCEYXXCCNPACXTXGCY

SEQ ID NO: 987 - protein, 18 aa, Artificial Sequence
  Synthetically generated peptide
  VARIANT 5, 6, 13, 16: Xaa = Any Amino Acid
CCEYXXCCNPACXTGXCY

SEQ ID NO: 988 - protein, 18 aa, Artificial Sequence
  Synthetically generated peptide
  VARIANT 5, 6, 13, 17: Xaa = Any Amino Acid
CCEYXXCCNPACXTGCXY

SEQ ID NO: 989 - protein, 17 aa, Artificial Sequence
  Synthetically generated peptide
  VARIANT 5, 6, 14: Xaa = Any Amino Acid
CCEYXXCCNPACTXGCY

SEQ ID NO: 990 - protein, 18 aa, Artificial Sequence
  Synthetically generated peptide
  VARIANT 5, 6, 14, 15: Xaa = Any Amino Acid
CCEYXXCCNPACTXXGCY

SEQ ID NO: 991 - protein, 18 aa, Artificial Sequence
  Synthetically generated peptide
  VARIANT 5, 6, 14, 16: Xaa = Any Amino Acid
CCEYXXCCNPACTXGXCY

SEQ ID NO: 992 - protein, 18 aa, Artificial Sequence
  Synthetically generated peptide
  VARIANT 5, 6, 14, 17: Xaa = Any Amino Acid
CCEYXXCCNPACTXGCXY

SEQ ID NO: 993 - protein, 17 aa, Artificial Sequence
  Synthetically generated peptide
  VARIANT 5, 6, 15: Xaa = Any Amino Acid
CCEYXXCCNPACTGXCY

SEQ ID NO: 994 - protein, 18 aa, Artificial Sequence
  Synthetically generated peptide
  VARIANT 5, 6, 15, 16: Xaa = Any Amino Acid
CCEYXXCCNPACTGXXCY

SEQ ID NO: 995 - protein, 18 aa, Artificial Sequence
  Synthetically generated peptide
  VARIANT 5, 6, 15, 17: Xaa = Any Amino Acid
CCEYXXCCNPACTGXCXY

SEQ ID NO: 996 - protein, 17 aa, Artificial Sequence
  Synthetically generated peptide
  VARIANT 5, 6, 16: Xaa = Any Amino Acid
CCEYXXCCNPACTGCXY

SEQ ID NO: 997 - protein, 18 aa, Artificial Sequence
  Synthetically generated peptide
  VARIANT 5, 6, 16, 17: Xaa = Any Amino Acid
CCEYXXCCNPACTGCXXY

SEQ ID NO: 998 - protein, 16 aa, Artificial Sequence
  Synthetically generated peptide
  VARIANT 5, 8: Xaa = Any Amino Acid
CCEYXCCXNPACTGCY

SEQ ID NO: 999 - protein, 17 aa, Artificial Sequence
  Synthetically generated peptide
  VARIANT 5, 8, 9: Xaa = Any Amino Acid
CCEYXCCXXNPACTGCY

SEQ ID NO: 1000 - protein, 18 aa, Artificial Sequence
  Synthetically generated peptide
  VARIANT 5, 8, 9, 10: Xaa = Any Amino Acid
CCEYXCCXXXNPACTGCY

SEQ ID NO: 1001 - protein, 18 aa, Artificial Sequence
  Synthetically generated peptide
  VARIANT 5, 8, 9, 11: Xaa = Any Amino Acid
CCEYXCCXXNXPACTGCY

SEQ ID NO: 1002 - protein, 18 aa, Artificial Sequence
  Synthetically generated peptide
  VARIANT 5, 8, 9, 12: Xaa = Any Amino Acid
CCEYXCCXXNPXACTGCY

SEQ ID NO: 1003 - protein, 18 aa, Artificial Sequence
  Synthetically generated peptide
  VARIANT 5, 8, 9, 13: Xaa = Any Amino Acid
CCEYXCCXXNPAXCTGCY

SEQ ID NO: 1004 - protein, 18 aa, Artificial Sequence
  Synthetically generated peptide
  VARIANT 5, 8, 9, 14: Xaa = Any Amino Acid
CCEYXCCXXNPACXTGCY

SEQ ID NO: 1005 - protein, 18 aa, Artificial Sequence
  Synthetically generated peptide
  VARIANT 5, 8, 9, 15: Xaa = Any Amino Acid
CCEYXCCXXNPACTXGCY

SEQ ID NO: 1006 - protein, 18 aa, Artificial Sequence
  Synthetically generated peptide
  VARIANT 5, 8, 9, 16: Xaa = Any Amino Acid
CCEYXCCXXNPACTGXCY

SEQ ID NO: 1007 - protein, 18 aa, Artificial Sequence
  Synthetically generated peptide
  VARIANT 5, 8, 9, 17: Xaa = Any Amino Acid
CCEYXCCXXNPACTGCXY

SEQ ID NO: 1008 - protein, 17 aa, Artificial Sequence
  Synthetically generated peptide
  VARIANT 5, 8, 10: Xaa = Any Amino Acid
CCEYXCCXNXPACTGCY

SEQ ID NO: 1009 - protein, 18 aa, Artificial Sequence
  Synthetically generated peptide
  VARIANT 5, 8, 10, 11: Xaa = Any Amino Acid
CCEYXCCXNXXPACTGCY

SEQ ID NO: 1010 - protein, 18 aa, Artificial Sequence
  Synthetically generated peptide
  VARIANT 5, 8, 10, 12: Xaa = Any Amino Acid
CCEYXCCXNXPXACTGCY

SEQ ID NO: 1011 - protein, 18 aa, Artificial Sequence
  Synthetically generated peptide
  VARIANT 5, 8, 10, 13: Xaa = Any Amino Acid
CCEYXCCXNXPAXCTGCY

SEQ ID NO: 1012 - protein, 18 aa, Artificial Sequence
  Synthetically generated peptide
  VARIANT 5, 8, 10, 14: Xaa = Any Amino Acid
CCEYXCCXNXPACXTGCY

SEQ ID NO: 1013 - protein, 18 aa, Artificial Sequence
  Synthetically generated peptide
  VARIANT 5, 8, 10, 15: Xaa = Any Amino Acid
CCEYXCCXNXPACTXGCY

SEQ ID NO: 1014 - protein, 18 aa, Artificial Sequence
  Synthetically generated peptide
  VARIANT 5, 8, 10, 16: Xaa = Any Amino Acid
CCEYXCCXNXPACTGXCY

SEQ ID NO: 1015 - protein, 18 aa, Artificial Sequence
  Synthetically generated peptide
  VARIANT 5, 8, 10, 17: Xaa = Any Amino Acid
CCEYXCCXNXPACTGCXY

SEQ ID NO: 1016 - protein, 17 aa, Artificial Sequence
  Synthetically generated peptide
  VARIANT 5, 8, 11: Xaa = Any Amino Acid
CCEYXCCXNPXACTGCY

SEQ ID NO: 1017 - protein, 18 aa, Artificial Sequence
  Synthetically generated peptide
  VARIANT 5, 8, 11, 12: Xaa = Any Amino Acid
CCEYXCCXNPXXACTGCY

SEQ ID NO: 1018 - protein, 18 aa, Artificial Sequence
  Synthetically generated peptide
  VARIANT 5, 8, 11, 13: Xaa = Any Amino Acid
CCEYXCCXNPXAXCTGCY

SEQ ID NO: 1019 - protein, 18 aa, Artificial Sequence
  Synthetically generated peptide
  VARIANT 5, 8, 11, 14: Xaa = Any Amino Acid
CCEYXCCXNPXACXTGCY

SEQ ID NO: 1020 - protein, 18 aa, Artificial Sequence
  Synthetically generated peptide
  VARIANT 5, 8, 11, 15: Xaa = Any Amino Acid
CCEYXCCXNPXACTXGCY

SEQ ID NO: 1021 - protein, 18 aa, Artificial Sequence
  Synthetically generated peptide
  VARIANT 5, 8, 11, 16: Xaa = Any Amino Acid
CCEYXCCXNPXACTGXCY

SEQ ID NO: 1022 - protein, 18 aa, Artificial Sequence
  Synthetically generated peptide
  VARIANT 5, 8, 11, 17: Xaa = Any Amino Acid
CCEYXCCXNPXACTGCXY

SEQ ID NO: 1023 - protein, 17 aa, Artificial Sequence
  Synthetically generated peptide
  VARIANT 5, 8, 12: Xaa = Any Amino Acid
CCEYXCCXNPAXCTGCY

SEQ ID NO: 1024 - protein, 18 aa, Artificial Sequence
  Synthetically generated peptide
  VARIANT 5, 8, 12, 13: Xaa = Any Amino Acid
CCEYXCCXNPAXXCTGCY

SEQ ID NO: 1025 - protein, 18 aa, Artificial Sequence
  Synthetically generated peptide
  VARIANT 5, 8, 12, 14: Xaa = Any Amino Acid
CCEYXCCXNPAXCXTGCY

SEQ ID NO: 1026 - protein, 18 aa, Artificial Sequence
  Synthetically generated peptide
  VARIANT 5, 8, 12, 15: Xaa = Any Amino Acid
CCEYXCCXNPAXCTXGCY

SEQ ID NO: 1027 - protein, 18 aa, Artificial Sequence
  Synthetically generated peptide
  VARIANT 5, 8, 12, 16: Xaa = Any Amino Acid
CCEYXCCXNPAXCTGXCY

SEQ ID NO: 1028 - protein, 18 aa, Artificial Sequence
  Synthetically generated peptide
  VARIANT 5, 8, 12, 17: Xaa = Any Amino Acid
CCEYXCCXNPAXCTGCXY

SEQ ID NO: 1029 - protein, 17 aa, Artificial Sequence
  Synthetically generated peptide
  VARIANT 5, 8, 13: Xaa = Any Amino Acid
CCEYXCCXNPACXTGCY

SEQ ID NO: 1030 - protein, 18 aa, Artificial Sequence
  Synthetically generated peptide
  VARIANT 5, 8, 13, 14: Xaa = Any Amino Acid
CCEYXCCXNPACXXTGCY

SEQ ID NO: 1031 - protein, 18 aa, Artificial Sequence
  Synthetically generated peptide
  VARIANT 5, 8, 13, 15: Xaa = Any Amino Acid
CCEYXCCXNPACXTXGCY

SEQ ID NO: 1032 - protein, 18 aa, Artificial Sequence
  Synthetically generated peptide
  VARIANT 5, 8, 13, 16: Xaa = Any Amino Acid
CCEYXCCXNPACXTGXCY

SEQ ID NO: 1033 - protein, 18 aa, Artificial Sequence
  Synthetically generated peptide
  VARIANT 5, 8, 13, 17: Xaa = Any Amino Acid
CCEYXCCXNPACXTGCXY

SEQ ID NO: 1034 - protein, 17 aa, Artificial Sequence
  Synthetically generated peptide
  VARIANT 5, 8, 14: Xaa = Any Amino Acid
CCEYXCCXNPACTXGCY

SEQ ID NO: 1035 - protein, 18 aa, Artificial Sequence
  Synthetically generated peptide
  VARIANT 5, 8, 14, 15: Xaa = Any Amino Acid
CCEYXCCXNPACTXXGCY

SEQ ID NO: 1036 - protein, 18 aa, Artificial Sequence
  Synthetically generated peptide
  VARIANT 5, 8, 14, 16: Xaa = Any Amino Acid
CCEYXCCXNPACTXGXCY

SEQ ID NO: 1037 - protein, 18 aa, Artificial Sequence
  Synthetically generated peptide
  VARIANT 5, 8, 14, 17: Xaa = Any Amino Acid
CCEYXCCXNPACTXGCXY

SEQ ID NO: 1038 - protein, 17 aa, Artificial Sequence
  Synthetically generated peptide
  VARIANT 5, 8, 15: Xaa = Any Amino Acid
CCEYXCCXNPACTGXCY

SEQ ID NO: 1039 - protein, 18 aa, Artificial Sequence
  Synthetically generated peptide
  VARIANT 5, 8, 15, 16: Xaa = Any Amino Acid
CCEYXCCXNPACTGXXCY

SEQ ID NO: 1040 - protein, 18 aa, Artificial Sequence
  Synthetically generated peptide
  VARIANT 5, 8, 15, 17: Xaa = Any Amino Acid
CCEYXCCXNPACTGXCXY

SEQ ID NO: 1041 - protein, 17 aa, Artificial Sequence
  Synthetically generated peptide
  VARIANT 5, 8, 16: Xaa = Any Amino Acid
CCEYXCCXNPACTGCXY

SEQ ID NO: 1042 - protein, 18 aa, Artificial Sequence
  Synthetically generated peptide
  VARIANT 5, 8, 16, 17: Xaa = Any Amino Acid
CCEYXCCXNPACTGCXXY

SEQ ID NO: 1043 - protein, 16 aa, Artificial Sequence
  Synthetically generated peptide
  VARIANT 5, 9: Xaa = Any Amino Acid
CCEYXCCNXPACTGCY

SEQ ID NO: 1044 - protein, 17 aa, Artificial Sequence
  Synthetically generated peptide
  VARIANT 5, 9, 10: Xaa = Any Amino Acid
CCEYXCCNXXPACTGCY

SEQ ID NO: 1045 - protein, 18 aa, Artificial Sequence
  Synthetically generated peptide
  VARIANT 5, 9, 10, 11: Xaa = Any Amino Acid
CCEYXCCNXXXPACTGCY

SEQ ID NO: 1046 - protein, 18 aa, Artificial Sequence
  Synthetically generated peptide
  VARIANT 5, 9, 10, 12: Xaa = Any Amino Acid
CCEYXCCNXXPXACTGCY

SEQ ID NO: 1047 - protein, 18 aa, Artificial Sequence
  Synthetically generated peptide
  VARIANT 5, 9, 10, 13: Xaa = Any Amino Acid
CCEYXCCNXXPAXCTGCY

SEQ ID NO: 1048 - protein, 18 aa, Artificial Sequence
  Synthetically generated peptide
  VARIANT 5, 9, 10, 14: Xaa = Any Amino Acid
CCEYXCCNXXPACXTGCY

SEQ ID NO: 1049 - protein, 18 aa, Artificial Sequence
  Synthetically generated peptide
  VARIANT 5, 9, 10, 15: Xaa = Any Amino Acid
CCEYXCCNXXPACTXGCY

SEQ ID NO: 1050 - protein, 18 aa, Artificial Sequence
  Synthetically generated peptide
  VARIANT 5, 9, 10, 16: Xaa = Any Amino Acid
CCEYXCCNXXPACTGXCY

SEQ ID NO: 1051 - protein, 18 aa, Artificial Sequence
  Synthetically generated peptide
  VARIANT 5, 9, 10, 17: Xaa = Any Amino Acid
CCEYXCCNXXPACTGCXY

SEQ ID NO: 1052 - protein, 17 aa, Artificial Sequence
  Synthetically generated peptide
  VARIANT 5, 9, 11: Xaa = Any Amino Acid
CCEYXCCNXPXACTGCY

SEQ ID NO: 1053 - protein, 18 aa, Artificial Sequence
  Synthetically generated peptide
  VARIANT 5, 9, 11, 12: Xaa = Any Amino Acid
CCEYXCCNXPXXACTGCY

SEQ ID NO: 1054 - protein, 18 aa, Artificial Sequence
  Synthetically generated peptide
  VARIANT 5, 9, 11, 13: Xaa = Any Amino Acid
CCEYXCCNXPXAXCTGCY

SEQ ID NO: 1055 - protein, 18 aa, Artificial Sequence
  Synthetically generated peptide
  VARIANT 5, 9, 11, 14: Xaa = Any Amino Acid
CCEYXCCNXPXACXTGCY

SEQ ID NO: 1056 - protein, 18 aa, Artificial Sequence
  Synthetically generated peptide
  VARIANT 5, 9, 11, 15: Xaa = Any Amino Acid
CCEYXCCNXPXACTXGCY

SEQ ID NO: 1057 - protein, 18 aa, Artificial Sequence
  Synthetically generated peptide
  VARIANT 5, 9, 11, 16: Xaa = Any Amino Acid
CCEYXCCNXPXACTGXCY

SEQ ID NO: 1058 - protein, 18 aa, Artificial Sequence
  Synthetically generated peptide
  VARIANT 5, 9, 11, 17: Xaa = Any Amino Acid
CCEYXCCNXPXACTGCXY

SEQ ID NO: 1059 - protein, 17 aa, Artificial Sequence
  Synthetically generated peptide
  VARIANT 5, 9, 12: Xaa = Any Amino Acid
CCEYXCCNXPAXCTGCY

SEQ ID NO: 1060 - protein, 18 aa, Artificial Sequence
  Synthetically generated peptide
  VARIANT 5, 9, 12, 13: Xaa = Any Amino Acid
CCEYXCCNXPAXXCTGCY

SEQ ID NO: 1061 - protein, 18 aa, Artificial Sequence
  Synthetically generated peptide
  VARIANT 5, 9, 12, 14: Xaa = Any Amino Acid
CCEYXCCNXPAXCXTGCY

SEQ ID NO: 1062 - protein, 18 aa, Artificial Sequence
  Synthetically generated peptide
  VARIANT 5, 9, 12, 15: Xaa = Any Amino Acid
CCEYXCCNXPAXCTXGCY

SEQ ID NO: 1063 - protein, 18 aa, Artificial Sequence
  Synthetically generated peptide
  VARIANT 5, 9, 12, 16: Xaa = Any Amino Acid
CCEYXCCNXPAXCTGXCY

SEQ ID NO: 1064 - protein, 18 aa, Artificial Sequence
  Synthetically generated peptide
  VARIANT 5, 9, 12, 17: Xaa = Any Amino Acid
CCEYXCCNXPAXCTGCXY

SEQ ID NO: 1065 - protein, 17 aa, Artificial Sequence
  Synthetically generated peptide
  VARIANT 5, 9, 13: Xaa = Any Amino Acid
CCEYXCCNXPACXTGCY

SEQ ID NO: 1066 - protein, 18 aa, Artificial Sequence
  Synthetically generated peptide
  VARIANT (5, 9, 13, 14: Xaa = Any Amino Acid
CCEYXCCNXPACXXTGCY

SEQ ID NO: 1067 - protein, 18 aa, Artificial Sequence
  Synthetically generated peptide
  VARIANT 5, 9, 13, 15: Xaa = Any Amino Acid
CCEYXCCNXPACXTXGCY

SEQ ID NO: 1068 - protein, 18 aa, Artificial Sequence
  Synthetically generated peptide
  VARIANT 5, 9, 13, 16: Xaa = Any Amino Acid
CCEYXCCNXPACXTGXCY

SEQ ID NO: 1069 - protein, 18 aa, Artificial Sequence
  Synthetically generated peptide
  VARIANT 5, 9, 13, 17: Xaa = Any Amino Acid
CCEYXCCNXPACXTGCXY

SEQ ID NO: 1070 - protein, 17 aa, Artificial Sequence
  Synthetically generated peptide
  VARIANT 5, 9, 14: Xaa = Any Amino Acid
CCEYXCCNXPACTXGCY

SEQ ID NO: 1071 - protein, 18 aa, Artificial Sequence
  Synthetically generated peptide
  VARIANT 5, 9, 14, 15: Xaa = Any Amino Acid
CCEYXCCNXPACTXXGCY

SEQ ID NO: 1072 - protein, 18 aa, Artificial Sequence
  Synthetically generated peptide
  VARIANT 5, 9, 14, 16: Xaa = Any Amino Acid
CCEYXCCNXPACTXGXCY

SEQ ID NO: 1073 - protein, 18 aa, Artificial Sequence
  Synthetically generated peptide
  VARIANT 5, 9, 14, 17: Xaa = Any Amino Acid
CCEYXCCNXPACTXGCXY

SEQ ID NO: 1074 - protein, 17 aa, Artificial Sequence
  Synthetically generated peptide
  VARIANT 5, 9, 15: Xaa = Any Amino Acid
CCEYXCCNXPACTGXCY

SEQ ID NO: 1075 - protein, 18 aa, Artificial Sequence
  Synthetically generated peptide
  VARIANT 5, 9, 15, 16: Xaa = Any Amino Acid
CCEYXCCNXPACTGXXCY

SEQ ID NO: 1076 - protein, 18 aa, Artificial Sequence
  Synthetically generated peptide
  VARIANT 5, 9, 15, 17: Xaa = Any Amino Acid
CCEYXCCNXPACTGXCXY

SEQ ID NO: 1077 - protein, 17 aa, Artificial Sequence
  Synthetically generated peptide
  VARIANT 5, 9, 16: Xaa = Any Amino Acid
CCEYXCCNXPACTGCXY

SEQ ID NO: 1078 - protein, 18 aa, Artificial Sequence
  Synthetically generated peptide
  VARIANT 5, 9, 16, 17: Xaa = Any Amino Acid
CCEYXCCNXPACTGCXXY

SEQ ID NO: 1079 - protein, 16 aa, Artificial Sequence
  Synthetically generated peptide
  VARIANT 5, 10: Xaa = Any Amino Acid
CCEYXCCNPXACTGCY

SEQ ID NO: 1080 - protein, 17 aa, Artificial Sequence
  Synthetically generated peptide
  VARIANT 5, 10, 11: Xaa = Any Amino Acid
CCEYXCCNPXXACTGCY

SEQ ID NO: 1081 - protein, 18 aa, Artificial Sequence
  Synthetically generated peptide
  VARIANT 5, 10, 11, 12: Xaa = Any Amino Acid
CCEYXCCNPXXXACTGCY

SEQ ID NO: 1082 - protein, 18 aa, Artificial Sequence
  Synthetically generated peptide
  VARIANT 5, 10, 11, 13: Xaa = Any Amino Acid
CCEYXCCNPXXAXCTGCY

SEQ ID NO: 1083 - protein, 18 aa, Artificial Sequence
  Synthetically generated peptide
  VARIANT 5, 10, 11, 14: Xaa = Any Amino Acid
CCEYXCCNPXXACXTGCY

SEQ ID NO: 1084 - protein, 18 aa, Artificial Sequence
  Synthetically generated peptide
  VARIANT 5, 10, 11, 15: Xaa = Any Amino Acid
CCEYXCCNPXXACTXGCY

SEQ ID NO: 1085 - protein, 18 aa, Artificial Sequence
  Synthetically generated peptide
  VARIANT 5, 10, 11, 16: Xaa = Any Amino Acid
CCEYXCCNPXXACTGXCY

SEQ ID NO: 1086 - protein, 18 aa, Artificial Sequence
  Synthetically generated peptide
  VARIANT 5, 10, 11, 17: Xaa = Any Amino Acid
CCEYXCCNPXXACTGCXY

SEQ ID NO: 1087 - protein, 17 aa, Artificial Sequence
  Synthetically generated peptide
  VARIANT 5, 10, 12: Xaa = Any Amino Acid
CCEYXCCNPXAXCTGCY

SEQ ID NO: 1088 - protein, 18 aa, Artificial Sequence
  Synthetically generated peptide
  VARIANT 5, 10, 12, 13: Xaa = Any Amino Acid
CCEYXCCNPXAXXCTGCY

SEQ ID NO: 1089 - protein, 18 aa, Artificial Sequence
  Synthetically generated peptide
  VARIANT 5, 10, 12, 14: Xaa = Any Amino Acid
CCEYXCCNPXAXCXTGCY

SEQ ID NO: 1090 - protein, 18 aa, Artificial Sequence
  Synthetically generated peptide
  VARIANT 5, 10, 12, 15: Xaa = Any Amino Acid
CCEYXCCNPXAXCTXGCY

SEQ ID NO: 1091 - protein, 18 aa, Artificial Sequence
  Synthetically generated peptide
  VARIANT 5, 10, 12, 16: Xaa = Any Amino Acid
CCEYXCCNPXAXCTGXCY

SEQ ID NO: 1092 - protein, 17 aa, Artificial Sequence
  Synthetically generated peptide
  VARIANT 5, 10, 13: Xaa = Any Amino Acid
CCEYXCCNPXACXTGCY

SEQ ID NO: 1093 - protein, 18 aa, Artificial Sequence
  Synthetically generated peptide
  VARIANT 5, 10, 13, 14: Xaa = Any Amino Acid
CCEYXCCNPXACXXTGCY

SEQ ID NO: 1094 - protein, 18 aa, Artificial Sequence
  Synthetically generated peptide
  VARIANT 5, 10, 13, 15: Xaa = Any Amino Acid
CCEYXCCNPXACXTXGCY

SEQ ID NO: 1095 - protein, 18 aa, Artificial Sequence
  Synthetically generated peptide
  VARIANT 5, 10, 13, 16: Xaa = Any Amino Acid
CCEYXCCNPXACXTGXCY

SEQ ID NO: 1096 - protein, 18 aa, Artificial Sequence
  Synthetically generated peptide
  VARIANT 5, 10, 13, 17: Xaa = Any Amino Acid
CCEYXCCNPXACXTGCXY

SEQ ID NO: 1097 - protein, 17 aa, Artificial Sequence
  Synthetically generated peptide
  VARIANT 5, 10, 14: Xaa = Any Amino Acid
CCEYXCCNPXACTXGCY

SEQ ID NO: 1098 - protein, 18 aa, Artificial Sequence
  Synthetically generated peptide
  VARIANT 5, 10, 14, 15: Xaa = Any Amino Acid
CCEYXCCNPXACTXXGCY

SEQ ID NO: 1099 - protein, 18 aa, Artificial Sequence
  Synthetically generated peptide
  VARIANT 5, 10, 14, 16: Xaa = Any Amino Acid
CCEYXCCNPXACTXGXCY

SEQ ID NO: 1100 - protein, 18 aa, Artificial Sequence
  Synthetically generated peptide
  VARIANT 5, 10, 14, 17: Xaa = Any Amino Acid
CCEYXCCNPXACTXGCXY

SEQ ID NO: 1101 - protein, 17 aa, Artificial Sequence
  Synthetically generated peptide
  VARIANT 5, 10, 15: Xaa = Any Amino Acid
CCEYXCCNPXACTGXCY

SEQ ID NO: 1102 - protein, 18 aa, Artificial Sequence
  Synthetically generated peptide
  VARIANT 5, 10, 15, 16: Xaa = Any Amino Acid
CCEYXCCNPXACTGXXCY

SEQ ID NO: 1103 - protein, 18 aa, Artificial Sequence
  Synthetically generated peptide
  VARIANT 5, 10, 15, 17: Xaa = Any Amino Acid
CCEYXCCNPXACTGXCXY

SEQ ID NO: 1104 - protein, 17 aa, Artificial Sequence
  Synthetically generated peptide
  VARIANT 5, 10, 16: Xaa = Any Amino Acid
CCEYXCCNPXACTGCXY

SEQ ID NO: 1105 - protein, 18 aa, Artificial Sequence
  Synthetically generated peptide
  VARIANT 5, 10, 16, 17: Xaa = Any Amino Acid
CCEYXCCNPXACTGCXXY

SEQ ID NO: 1106 - protein, 16 aa, Artificial Sequence
  Synthetically generated peptide
  VARIANT 5, 11: Xaa = Any Amino Acid
CCEYXCCNPAXCTGCY

SEQ ID NO: 1107 - protein, 17 aa, Artificial Sequence
  Synthetically generated peptide
  VARIANT 5, 11, 12: Xaa = Any Amino Acid
CCEYXCCNPAXXCTGCY

SEQ ID NO: 1108 - protein, 18 aa, Artificial Sequence
  Synthetically generated peptide
  VARIANT 5, 11, 12, 13: Xaa = Any Amino Acid
CCEYXCCNPAXXXCTGCY

SEQ ID NO: 1109 - protein, 18 aa, Artificial Sequence
  Synthetically generated peptide
  VARIANT 5, 11, 12, 14: Xaa = Any Amino Acid
CCEYXCCNPAXXCXTGCY

SEQ ID NO: 1110 - protein, 18 aa, Artificial Sequence
  Synthetically generated peptide
  VARIANT 5, 11, 12, 15: Xaa = Any Amino Acid
CCEYXCCNPAXXCTXGCY

SEQ ID NO: 1111 - protein, 18 aa, Artificial Sequence
  Synthetically generated peptide
  VARIANT 5, 11, 12, 16: Xaa = Any Amino Acid
CCEYXCCNPAXXCTGXCY

SEQ ID NO: 1112 - protein, 18 aa, Artificial Sequence
  Synthetically generated peptide
  VARIANT 5, 11, 12, 17: Xaa = Any Amino Acid
CCEYXCCNPAXXCTGCXY

SEQ ID NO: 1113 - protein, 17 aa, Artificial Sequence
  Synthetically generated peptide
  VARIANT 5, 11, 13: Xaa = Any Amino Acid
CCEYXCCNPAXCXTGCY

SEQ ID NO: 1114 - protein, 18 aa, Artificial Sequence
  Synthetically generated peptide
  VARIANT 5, 11, 13, 14: Xaa = Any Amino Acid
CCEYXCCNPAXCXXTGCY

SEQ ID NO: 1115 - protein, 18 aa, Artificial Sequence
  Synthetically generated peptide
  VARIANT 5, 11, 13, 15: Xaa = Any Amino Acid
CCEYXCCNPAXCXTXGCY

SEQ ID NO: 1116 - protein, 18 aa, Artificial Sequence
  Synthetically generated peptide
  VARIANT 5, 11, 13, 16: Xaa = Any Amino Acid
CCEYXCCNPAXCXTGXCY

SEQ ID NO: 1117 - protein, 18 aa, Artificial Sequence
  Synthetically generated peptide
  VARIANT 5, 11, 13, 17: Xaa = Any Amino Acid
CCEYXCCNPAXCXTGCXY

SEQ ID NO: 1118 - protein, 17 aa, Artificial Sequence
  Synthetically generated peptide
  VARIANT 5, 11, 14: Xaa = Any Amino Acid
CCEYXCCNPAXCTXGCY

SEQ ID NO: 1119 - protein, 18 aa, Artificial Sequence
  Synthetically generated peptide
  VARIANT 5, 11, 14, 15: Xaa = Any Amino Acid
CCEYXCCNPAXCTXXGCY

SEQ ID NO: 1120 - protein, 18 aa, Artificial Sequence
  Synthetically generated peptide
  VARIANT 5, 11, 14, 16: Xaa = Any Amino Acid
CCEYXCCNPAXCTXGXCY

SEQ ID NO: 1121 - protein, 18 aa, Artificial Sequence
  Synthetically generated peptide
  VARIANT 5, 11, 14, 17: Xaa = Any Amino Acid
CCEYXCCNPAXCTXGCXY

SEQ ID NO: 1122 - protein, 17 aa, Artificial Sequence
  Synthetically generated peptide
  VARIANT 5, 11, 15: Xaa = Any Amino Acid
CCEYXCCNPAXCTGXCY

SEQ ID NO: 1123 - protein, 18 aa, Artificial Sequence
  Synthetically generated peptide
  VARIANT 5, 11, 15, 16: Xaa = Any Amino Acid
CCEYXCCNPAXCTGXXCY

SEQ ID NO: 1124 - protein, 18 aa, Artificial Sequence
  Synthetically generated peptide
  VARIANT 5, 11, 15, 17: Xaa = Any Amino Acid
CCEYXCCNPAXCTGXCXY

SEQ ID NO: 1125 - protein, 17 aa, Artificial Sequence
  Synthetically generated peptide
  VARIANT 5, 11, 16: Xaa = Any Amino Acid
CCEYXCCNPAXCTGCXY

SEQ ID NO: 1126 - protein, 18 aa, Artificial Sequence
  Synthetically generated peptide
  VARIANT 5, 11, 16, 17: Xaa = Any Amino Acid
CCEYXCCNPAXCTGCXXY

SEQ ID NO: 1127 - protein, 16 aa, Artificial Sequence
  Synthetically generated peptide
  VARIANT 5, 12: Xaa = Any Amino Acid
CCEYXCCNPACXTGCY

SEQ ID NO: 1128 - protein, 17 aa, Artificial Sequence
  Synthetically generated peptide
  VARIANT 5, 12, 13: Xaa = Any Amino Acid
CCEYXCCNPACXXTGCY

SEQ ID NO: 1129 - protein, 18 aa, Artificial Sequence
  Synthetically generated peptide
  VARIANT 5, 12, 13, 14: Xaa = Any Amino Acid
CCEYXCCNPACXXXTGCY

SEQ ID NO: 1130 - protein, 18 aa, Artificial Sequence
  Synthetically generated peptide
  VARIANT 5, 12, 13, 15: Xaa = Any Amino Acid
CCEYXCCNPACXXTXGCY

SEQ ID NO: 1131 - protein, 18 aa, Artificial Sequence
  Synthetically generated peptide
  VARIANT 5, 12, 13, 16: Xaa = Any Amino Acid
CCEYXCCNPACXXTGXCY

SEQ ID NO: 1132 - protein, 18 aa, Artificial Sequence
  Synthetically generated peptide
  VARIANT 5, 12, 13, 17: Xaa = Any Amino Acid
CCEYXCCNPACXXTGCXY

SEQ ID NO: 1133 - protein, 17 aa, Artificial Sequence
  Synthetically generated peptide
  VARIANT 5, 12, 14: Xaa = Any Amino Acid
CCEYXCCNPACXTXGCY

SEQ ID NO: 1134 - protein, 18 aa, Artificial Sequence
  Synthetically generated peptide
  VARIANT 5, 12, 14, 15: Xaa = Any Amino Acid
CCEYXCCNPACXTXXGCY

SEQ ID NO: 1135 - protein, 18 aa, Artificial Sequence
  Synthetically generated peptide
  VARIANT 5, 12, 14, 16: Xaa = Any Amino Acid
CCEYXCCNPACXTXGXCY

SEQ ID NO: 1136 - protein, 18 aa, Artificial Sequence
  Synthetically generated peptide
  VARIANT 5, 12, 14, 17: Xaa = Any Amino Acid
CCEYXCCNPACXTXGCXY

SEQ ID NO: 1137 - protein, 17 aa, Artificial Sequence
  Synthetically generated peptide
  VARIANT 5, 12, 15: Xaa = Any Amino Acid
CCEYXCCNPACXTGXCY

SEQ ID NO: 1138 - protein, 18 aa, Artificial Sequence
  Synthetically generated peptide
  VARIANT 5, 12, 15, 16: Xaa = Any Amino Acid
CCEYXCCNPACXTGXXCY

SEQ ID NO: 1139 - protein, 18 aa, Artificial Sequence
  Synthetically generated peptide
  VARIANT 5, 12, 15, 17: Xaa = Any Amino Acid
CCEYXCCNPACXTGXCXY

SEQ ID NO: 1140 - protein, 17 aa, Artificial Sequence
  Synthetically generated peptide
  VARIANT 5, 12, 16: Xaa = Any Amino Acid
CCEYXCCNPACXTGCXY

SEQ ID NO: 1141 - protein, 18 aa, Artificial Sequence
  Synthetically generated peptide
  VARIANT 5, 12, 16, 17: Xaa = Any Amino Acid
CCEYXCCNPACXTGCXXY

SEQ ID NO: 1142 - protein, 16 aa, Artificial Sequence
  Synthetically generated peptide
  VARIANT 5, 13: Xaa = Any Amino Acid
CCEYXCCNPACTXGCY

SEQ ID NO: 1143 - protein, 17 aa, Artificial Sequence
  Synthetically generated peptide
  VARIANT 5, 13, 14: Xaa = Any Amino Acid
CCEYXCCNPACTXXGCY

SEQ ID NO: 1144 - protein, 18 aa, Artificial Sequence
  Synthetically generated peptide
  VARIANT 5, 13, 14, 15: Xaa = Any Amino Acid
CCEYXCCNPACTXXXGCY

SEQ ID NO: 1145 - protein, 18 aa, Artificial Sequence
  Synthetically generated peptide
  VARIANT 5, 13, 14, 16: Xaa = Any Amino Acid
CCEYXCCNPACTXXGXCY

SEQ ID NO: 1146 - protein, 18 aa, Artificial Sequence
  Synthetically generated peptide
  VARIANT 5, 13, 14, 17: Xaa = Any Amino Acid
CCEYXCCNPACTXXGCXY

SEQ ID NO: 1147 - protein, 17 aa, Artificial Sequence
  Synthetically generated peptide
  VARIANT 5, 13, 15: Xaa = Any Amino Acid
CCEYXCCNPACTXGXCY

SEQ ID NO: 1148 - protein, 18 aa, Artificial Sequence
  Synthetically generated peptide
  VARIANT 5, 13, 15, 16: Xaa = Any Amino Acid
CCEYXCCNPACTXGXXCY

SEQ ID NO: 1149 - protein, 18 aa, Artificial Sequence
  Synthetically generated peptide
  VARIANT 5, 13, 15, 17: Xaa = Any Amino Acid
CCEYXCCNPACTXGXCXY

SEQ ID NO: 1150 - protein, 17 aa, Artificial Sequence
  Synthetically generated peptide
  VARIANT 5, 13, 16: Xaa = Any Amino Acid
CCEYXCCNPACTXGCXY

SEQ ID NO: 1151 - protein, 18 aa, Artificial Sequence
  Synthetically generated peptide
  VARIANT 5, 13, 16, 17: Xaa = Any Amino Acid
CCEYXCCNPACTXGCXXY

SEQ ID NO: 1152 - protein, 16 aa, Artificial Sequence
  Synthetically generated peptide
  VARIANT 5, 14: Xaa = Any Amino Acid
CCEYXCCNPACTGXCY

SEQ ID NO: 1153 - protein, 17 aa, Artificial Sequence
  Synthetically generated peptide
  VARIANT 5, 14, 15: Xaa = Any Amino Acid
CCEYXCCNPACTGXXCY

SEQ ID NO: 1154 - protein, 18 aa, Artificial Sequence
  Synthetically generated peptide
  VARIANT 5, 14, 15, 16: Xaa = Any Amino Acid
CCEYXCCNPACTGXXXCY

SEQ ID NO: 1155 - protein, 18 aa, Artificial Sequence
  Synthetically generated peptide
  VARIANT 5, 14, 15, 17: Xaa = Any Amino Acid
CCEYXCCNPACTGXXCXY

SEQ ID NO: 1156 - protein, 17 aa, Artificial Sequence
  Synthetically generated peptide
  VARIANT 5, 14, 16: Xaa = Any Amino Acid
CCEYXCCNPACTGXCXY

SEQ ID NO: 1157 - protein, 18 aa, Artificial Sequence
  Synthetically generated peptide
  VARIANT 5, 14, 16, 17: Xaa = Any Amino Acid
CCEYXCCNPACTGXCXXY

SEQ ID NO: 1158 - protein, 16 aa, Artificial Sequence
  Synthetically generated peptide
  VARIANT 5, 15: Xaa = Any Amino Acid
CCEYXCCNPACTGCXY

SEQ ID NO: 1159 - protein, 17 aa, Artificial Sequence
  Synthetically generated peptide
  VARIANT 5, 15, 16: Xaa = Any Amino Acid
CCEYXCCNPACTGCXXY

SEQ ID NO: 1160 - protein, 18 aa, Artificial Sequence
  Synthetically generated peptide
  VARIANT 5, 15, 16, 17: Xaa = Any Amino Acid
CCEYXCCNPACTGCXXXY

SEQ ID NO: 1161 - protein, 15 aa, Artificial Sequence
  Synthetically generated peptide
  VARIANT 7: Xaa = Any Amino Acid
CCEYCCXNPACTGCY

SEQ ID NO: 1162 - protein, 16 aa, Artificial Sequence
  Synthetically generated peptide
  VARIANT 7, 8: Xaa = Any Amino Acid
CCEYCCXXNPACTGCY

SEQ ID NO: 1163 - protein, 17 aa, Artificial Sequence
  Synthetically generated peptide
  VARIANT 7, 8, 9: Xaa = Any Amino Acid
CCEYCCXXXNPACTGCY

SEQ ID NO: 1164 - protein, 18 aa, Artificial Sequence
  Synthetically generated peptide
  VARIANT 7, 8, 9, 10: Xaa = Any Amino Acid
CCEYCCXXXXNPACTGCY

SEQ ID NO: 1165 - protein, 18 aa, Artificial Sequence
  Synthetically generated peptide
  VARIANT 7, 8, 9, 11: Xaa = Any Amino Acid
CCEYCCXXXNXPACTGCY

SEQ ID NO: 1166 - protein, 18 aa, Artificial Sequence
  Synthetically generated peptide
  VARIANT 7, 8, 9, 12: Xaa = Any Amino Acid
CCEYCCXXXNPXACTGCY

SEQ ID NO: 1167 - protein, 18 aa, Artificial Sequence
  Synthetically generated peptide
  VARIANT 7, 8, 9, 13: Xaa = Any Amino Acid
CCEYCCXXXNPAXCTGCY

SEQ ID NO: 1168 - protein, 18 aa, Artificial Sequence
  Synthetically generated peptide
  VARIANT 7, 8, 9, 14: Xaa = Any Amino Acid
CCEYCCXXXNPACXTGCY

SEQ ID NO: 1169 - protein, 18 aa, Artificial Sequence
  Synthetically generated peptide
  VARIANT 7, 8, 9, 15: Xaa = Any Amino Acid
CCEYCCXXXNPACTXGCY

SEQ ID NO: 1170 - protein, 18 aa, Artificial Sequence
  Synthetically generated peptide
  VARIANT 7, 8, 9, 16: Xaa = Any Amino Acid
CCEYCCXXXNPACTGXCY

SEQ ID NO: 1171 - protein, 18 aa, Artificial Sequence
  Synthetically generated peptide
  VARIANT 7, 8, 9, 17: Xaa = Any Amino Acid
CCEYCCXXXNPACTGCXY

SEQ ID NO: 1172 - protein, 17 aa, Artificial Sequence
  Synthetically generated peptide
  VARIANT 7, 8, 10: Xaa = Any Amino Acid
CCEYCCXXNXPACTGCY

SEQ ID NO: 1173 - protein, 18 aa, Artificial Sequence
  Synthetically generated peptide
  VARIANT 7, 8, 10, 11: Xaa = Any Amino Acid
CCEYCCXXNXXPACTGCY

SEQ ID NO: 1174 - protein, 18 aa, Artificial Sequence
  Synthetically generated peptide
  VARIANT 7, 8, 10, 12: Xaa = Any Amino Acid
CCEYCCXXNXPXACTGCY

SEQ ID NO: 1175 - protein, 18 aa, Artificial Sequence
  Synthetically generated peptide
  VARIANT 7, 8, 10, 13: Xaa = Any Amino Acid
CCEYCCXXNXPAXCTGCY

SEQ ID NO: 1176 - protein, 18 aa, Artificial Sequence
  Synthetically generated peptide
  VARIANT 7, 8, 10, 14: Xaa = Any Amino Acid
CCEYCCXXNXPACXTGCY

SEQ ID NO: 1177 - protein, 18 aa, Artificial Sequence
  Synthetically generated peptide
  VARIANT 7, 8, 10, 15: Xaa = Any Amino Acid
CCEYCCXXNXPACTXGCY

SEQ ID NO: 1178 - protein, 18 aa, Artificial Sequence
  Synthetically generated peptide
  VARIANT 7, 8, 10, 16: Xaa = Any Amino Acid
CCEYCCXXNXPACTGXCY

SEQ ID NO: 1179 - protein, 18 aa, Artificial Sequence
  Synthetically generated peptide
  VARIANT 7, 8, 10, 17: Xaa = Any Amino Acid
CCEYCCXXNXPACTGCXY

SEQ ID NO: 1180 - protein, 17 aa, Artificial Sequence
  Synthetically generated peptide
  VARIANT 7, 8, 11: Xaa = Any Amino Acid
CCEYCCXXNPXACTGCY

SEQ ID NO: 1181 - protein, 18 aa, Artificial Sequence
  Synthetically generated peptide
  VARIANT 7, 8, 11, 12: Xaa = Any Amino Acid
CCEYCCXXNPXXACTGCY

SEQ ID NO: 1182 - protein, 18 aa, Artificial Sequence
  Synthetically generated peptide
  VARIANT 7, 8, 11, 13: Xaa = Any Amino Acid
CCEYCCXXNPXAXCTGCY

SEQ ID NO: 1183 - protein, 18 aa, Artificial Sequence
  Synthetically generated peptide
  VARIANT 7, 8, 11, 14: Xaa = Any Amino Acid
CCEYCCXXNPXACXTGCY

SEQ ID NO: 1184 - protein, 18 aa, Artificial Sequence
  Synthetically generated peptide
  VARIANT 7, 8, 11, 15: Xaa = Any Amino Acid
CCEYCCXXNPXACTXGCY

SEQ ID NO: 1185 - protein, 18 aa, Artificial Sequence
  Synthetically generated peptide
  VARIANT 7, 8, 11, 16: Xaa = Any Amino Acid
CCEYCCXXNPXACTGXCY

SEQ ID NO: 1186 - protein, 18 aa, Artificial Sequence
  Synthetically generated peptide
  VARIANT 7, 8, 11, 17: Xaa = Any Amino Acid
CCEYCCXXNPXACTGCXY

SEQ ID NO: 1187 - protein, 17 aa, Artificial Sequence
  Synthetically generated peptide
  VARIANT 7, 8, 12: Xaa = Any Amino Acid
CCEYCCXXNPAXCTGCY

SEQ ID NO: 1188 - protein, 18 aa, Artificial Sequence
  Synthetically generated peptide
  VARIANT 7, 8, 12, 13: Xaa = Any Amino Acid
CCEYCCXXNPAXXCTGCY

SEQ ID NO: 1189 - protein, 18 aa, Artificial Sequence
  Synthetically generated peptide
  VARIANT 7, 8, 12, 14: Xaa = Any Amino Acid
CCEYCCXXNPAXCXTGCY

SEQ ID NO: 1190 - protein, 18 aa, Artificial Sequence
  Synthetically generated peptide
  VARIANT 7, 8, 12, 15: Xaa = Any Amino Acid
CCEYCCXXNPAXCTXGCY

SEQ ID NO: 1191 - protein, 18 aa, Artificial Sequence
  Synthetically generated peptide
  VARIANT 7, 8, 12, 16: Xaa = Any Amino Acid
CCEYCCXXNPAXCTGXCY

SEQ ID NO: 1192 - protein, 18 aa, Artificial Sequence
  Synthetically generated peptide
  VARIANT 7, 8, 12, 17: Xaa = Any Amino Acid
CCEYCCXXNPAXCTGCXY

SEQ ID NO: 1193 - protein, 17 aa, Artificial Sequence
  Synthetically generated peptide
  VARIANT 7, 8, 13: Xaa = Any Amino Acid
CCEYCCXXNPACXTGCY

SEQ ID NO: 1194 - protein, 18 aa, Artificial Sequence
  Synthetically generated peptide
  VARIANT 7, 8, 13, 14: Xaa = Any Amino Acid
CCEYCCXXNPACXXTGCY

SEQ ID NO: 1195 - protein, 18 aa, Artificial Sequence
  Synthetically generated peptide
  VARIANT 7, 8, 13, 15: Xaa = Any Amino Acid
CCEYCCXXNPACXTXGCY

SEQ ID NO: 1196 - protein, 18 aa, Artificial Sequence
  Synthetically generated peptide
  VARIANT 7, 8, 13, 16: Xaa = Any Amino Acid
CCEYCCXXNPACXTGXCY

SEQ ID NO: 1197 - protein, 18 aa, Artificial Sequence
  Synthetically generated peptide
  VARIANT 7, 8, 13, 17: Xaa = Any Amino Acid
CCEYCCXXNPACXTGCXY

SEQ ID NO: 1198 - protein, 17 aa, Artificial Sequence
  Synthetically generated peptide
  VARIANT 7, 8, 14: Xaa = Any Amino Acid
CCEYCCXXNPACTXGCY

SEQ ID NO: 1199 - protein, 18 aa, Artificial Sequence
  Synthetically generated peptide
  VARIANT 7, 8, 14, 15: Xaa = Any Amino Acid
CCEYCCXXNPACTXXGCY

SEQ ID NO: 1200 - protein, 18 aa, Artificial Sequence
  Synthetically generated peptide
  VARIANT 7, 8, 14, 16: Xaa = Any Amino Acid
CCEYCCXXNPACTXGXCY

SEQ ID NO: 1201 - protein, 18 aa, Artificial Sequence
  Synthetically generated peptide
  VARIANT 7, 8, 14, 17: Xaa = Any Amino Acid
CCEYCCXXNPACTXGCXY

SEQ ID NO: 1202 - protein, 17 aa, Artificial Sequence
  Synthetically generated peptide
  VARIANT 7, 8, 15: Xaa = Any Amino Acid
CCEYCCXXNPACTGXCY

SEQ ID NO: 1203 - protein, 18 aa, Artificial Sequence
  Synthetically generated peptide
  VARIANT 7, 8, 15, 16: Xaa = Any Amino Acid
CCEYCCXXNPACTGXXCY

SEQ ID NO: 1204 - protein, 18 aa, Artificial Sequence
  Synthetically generated peptide
  VARIANT 7, 8, 15, 17: Xaa = Any Amino Acid
CCEYCCXXNPACTGXCXY

SEQ ID NO: 1205 - protein, 17 aa, Artificial Sequence
  Synthetically generated peptide
  VARIANT 7, 8, 16: Xaa = Any Amino Acid
CCEYCCXXNPACTGCXY

SEQ ID NO: 1206 - protein, 18 aa, Artificial Sequence
  Synthetically generated peptide
  VARIANT 7, 8, 16, 17: Xaa = Any Amino Acid
CCEYCCXXNPACTGCXXY

SEQ ID NO: 1207 - protein, 16 aa, Artificial Sequence
  Synthetically generated peptide
  VARIANT 7, 9: Xaa = Any Amino Acid
CCEYCCXNXPACTGCY

SEQ ID NO: 1208 - protein, 17 aa, Artificial Sequence
  Synthetically generated peptide
  VARIANT 7, 9, 10: Xaa = Any Amino Acid
CCEYCCXNXXPACTGCY

SEQ ID NO: 1209 - protein, 18 aa, Artificial Sequence
  Synthetically generated peptide
  VARIANT 7, 9, 10, 11: Xaa = Any Amino Acid
CCEYCCXNXXXPACTGCY

SEQ ID NO: 1210 - protein, 18 aa, Artificial Sequence
  Synthetically generated peptide
  VARIANT 7, 9, 10, 12: Xaa = Any Amino Acid
CCEYCCXNXXPXACTGCY

SEQ ID NO: 1211 - protein, 18 aa, Artificial Sequence
  Synthetically generated peptide
  VARIANT 7, 9, 10, 13: Xaa = Any Amino Acid
CCEYCCXNXXPAXCTGCY

SEQ ID NO: 1212 - protein, 18 aa, Artificial Sequence
  Synthetically generated peptide
  VARIANT 7, 9, 10, 14: Xaa = Any Amino Acid
CCEYCCXNXXPACXTGCY

SEQ ID NO: 1213 - protein, 18 aa, Artificial Sequence
  Synthetically generated peptide
  VARIANT 7, 9, 10, 15: Xaa = Any Amino Acid
CCEYCCXNXXPACTXGCY

SEQ ID NO: 1214 - protein, 18 aa, Artificial Sequence
  Synthetically generated peptide
  VARIANT 7, 9, 10, 16: Xaa = Any Amino Acid
CCEYCCXNXXPACTGXCY

SEQ ID NO: 1215 - protein, 18 aa, Artificial Sequence
  Synthetically generated peptide
  VARIANT 7, 9, 10, 17: Xaa = Any Amino Acid
CCEYCCXNXXPACTGCXY

SEQ ID NO: 1216 - protein, 17 aa, Artificial Sequence
  Synthetically generated peptide
  VARIANT 7, 9, 11: Xaa = Any Amino Acid
CCEYCCXNXPXACTGCY

SEQ ID NO: 1217 - protein, 18 aa, Artificial Sequence
  Synthetically generated peptide
  VARIANT 7, 9, 11, 12: Xaa = Any Amino Acid
CCEYCCXNXPXXACTGCY

SEQ ID NO: 1218 - protein, 18 aa, Artificial Sequence
  Synthetically generated peptide
  VARIANT 7, 9, 11, 13: Xaa = Any Amino Acid
CCEYCCXNXPXAXCTGCY

SEQ ID NO: 1219 - protein, 18 aa, Artificial Sequence
  Synthetically generated peptide
  VARIANT 7, 9, 11, 14: Xaa = Any Amino Acid
CCEYCCXNXPXACXTGCY

SEQ ID NO: 1220 - protein, 18 aa, Artificial Sequence
  Synthetically generated peptide
  VARIANT 7, 9, 11, 15: Xaa = Any Amino Acid
CCEYCCXNXPXACTXGCY

SEQ ID NO: 1221 - protein, 18 aa, Artificial Sequence
  Synthetically generated peptide
  VARIANT 7, 9, 11, 16: Xaa = Any Amino Acid
CCEYCCXNXPXACTGXCY

SEQ ID NO: 1222 - protein, 18 aa, Artificial Sequence
  Synthetically generated peptide
  VARIANT 7, 9, 11, 17: Xaa = Any Amino Acid
CCEYCCXNXPXACTGCXY

SEQ ID NO: 1223 - protein, 17 aa, Artificial Sequence
  Synthetically generated peptide
  VARIANT 7, 9, 12: Xaa = Any Amino Acid
CCEYCCXNXPAXCTGCY

SEQ ID NO: 1224 - protein, 18 aa, Artificial Sequence
  Synthetically generated peptide
  VARIANT 7, 9, 12, 13: Xaa = Any Amino Acid
CCEYCCXNXPAXXCTGCY

SEQ ID NO: 1225 - protein, 18 aa, Artificial Sequence
  Synthetically generated peptide
  VARIANT 7, 9, 12, 14 ): Xaa = Any Amino Acid
CCEYCCXNXPAXCXTGCY

SEQ ID NO: 1226 - protein, 18 aa, Artificial Sequence
  Synthetically generated peptide
  VARIANT 7, 9, 12, 15: Xaa = Any Amino Acid
CCEYCCXNXPAXCTXGCY

SEQ ID NO: 1227 - protein, 18 aa, Artificial Sequence
  Synthetically generated peptide
  VARIANT 7, 9, 12, 16: Xaa = Any Amino Acid
CCEYCCXNXPAXCTGXCY

SEQ ID NO: 1228 - protein, 18 aa, Artificial Sequence
  Synthetically generated peptide
  VARIANT 7, 9, 12, 17: Xaa = Any Amino Acid
CCEYCCXNXPAXCTGCXY

SEQ ID NO: 1229 - protein, 17 aa, Artificial Sequence
  Synthetically generated peptide
  VARIANT 7, 9, 13: Xaa = Any Amino Acid
CCEYCCXNXPACXTGCY

SEQ ID NO: 1230 - protein, 18 aa, Artificial Sequence
  Synthetically generated peptide
  VARIANT 7, 9, 13, 14: Xaa = Any Amino Acid
CCEYCCXNXPACXXTGCY

SEQ ID NO: 1231 - protein, 18 aa, Artificial Sequence
  Synthetically generated peptide
  VARIANT 7, 9, 13, 15: Xaa = Any Amino Acid
CCEYCCXNXPACXTXGCY

SEQ ID NO: 1232 - protein, 18 aa, Artificial Sequence
  Synthetically generated peptide
  VARIANT 7, 9, 13, 16: Xaa = Any Amino Acid
CCEYCCXNXPACXTGXCY

SEQ ID NO: 1233 - protein, 18 aa, Artificial Sequence
  Synthetically generated peptide
  VARIANT 7, 9, 13, 17: Xaa = Any Amino Acid
CCEYCCXNXPACXTGCXY

SEQ ID NO: 1234 - protein, 17 aa, Artificial Sequence
  Synthetically generated peptide
  VARIANT 7, 9, 14: Xaa = Any Amino Acid
CCEYCCXNXPACTXGCY

SEQ ID NO: 1235 - protein, 18 aa, Artificial Sequence
  Synthetically generated peptide
  VARIANT 7, 9, 14, 15: Xaa = Any Amino Acid
CCEYCCXNXPACTXXGCY

SEQ ID NO: 1236 - protein, 18 aa, Artificial Sequence
  Synthetically generated peptide
  VARIANT 7, 9, 14, 16: Xaa = Any Amino Acid
CCEYCCXNXPACTXGXCY

SEQ ID NO: 1237 - protein, 18 aa, Artificial Sequence
  Synthetically generated peptide
  VARIANT 7, 9, 14, 17: Xaa = Any Amino Acid
CCEYCCXNXPACTXGCXY

SEQ ID NO: 1238 - protein, 17 aa, Artificial Sequence
  Synthetically generated peptide
  VARIANT 7, 9, 15: Xaa = Any Amino Acid
CCEYCCXNXPACTGXCY

SEQ ID NO: 1239 - protein, 18 aa, Artificial Sequence
  Synthetically generated peptide
  VARIANT 7, 9, 15, 16: Xaa = Any Amino Acid
CCEYCCXNXPACTGXXCY

SEQ ID NO: 1240 - protein, 18 aa, Artificial Sequence
  Synthetically generated peptide
  VARIANT 7, 9, 15, 17: Xaa = Any Amino Acid
CCEYCCXNXPACTGXCXY

SEQ ID NO: 1241 - protein, 17 aa, Artificial Sequence
  Synthetically generated peptide
  VARIANT 7, 9, 16: Xaa = Any Amino Acid
CCEYCCXNXPACTGCXY

SEQ ID NO: 1242 - protein, 18 aa, Artificial Sequence
  Synthetically generated peptide
  VARIANT 7, 9, 16, 17: Xaa = Any Amino Acid
CCEYCCXNXPACTGCXXY

SEQ ID NO: 1243 - protein, 16 aa, Artificial Sequence
  Synthetically generated peptide
  VARIANT 7, 10: Xaa = Any Amino Acid
CCEYCCXNPXACTGCY

SEQ ID NO: 1244 - protein, 17 aa, Artificial Sequence
  Synthetically generated peptide
  VARIANT 7, 10, 11: Xaa = Any Amino Acid
CCEYCCXNPXXACTGCY

SEQ ID NO: 1245 - protein, 18 aa, Artificial Sequence
  Synthetically generated peptide
  VARIANT 7, 10, 11, 12: Xaa = Any Amino Acid
CCEYCCXNPXXXACTGCY

SEQ ID NO: 1246 - protein, 18 aa, Artificial Sequence
  Synthetically generated peptide
  VARIANT 7, 10, 11, 13: Xaa = Any Amino Acid
CCEYCCXNPXXAXCTGCY

SEQ ID NO: 1247 - protein, 18 aa, Artificial Sequence
  Synthetically generated peptide
  VARIANT 7, 10, 11, 14: Xaa = Any Amino Acid
CCEYCCXNPXXACXTGCY

SEQ ID NO: 1248 - protein, 18 aa, Artificial Sequence
  Synthetically generated peptide
  VARIANT 7, 10, 11, 15: Xaa = Any Amino Acid
CCEYCCXNPXXACTXGCY

SEQ ID NO: 1249 - protein, 18 aa, Artificial Sequence
  Synthetically generated peptide
  VARIANT 7, 10, 11, 16: Xaa = Any Amino Acid
CCEYCCXNPXXACTGXCY

SEQ ID NO: 1250 - protein, 18 aa, Artificial Sequence
  Synthetically generated peptide
  VARIANT 7, 10, 11, 17: Xaa = Any Amino Acid
CCEYCCXNPXXACTGCXY

SEQ ID NO: 1251 - protein, 17 aa, Artificial Sequence
  Synthetically generated peptide
  VARIANT 7, 10, 12: Xaa = Any Amino Acid
CCEYCCXNPXAXCTGCY

SEQ ID NO: 1252 - protein, 18 aa, Artificial Sequence
  Synthetically generated peptide
  VARIANT 7, 10, 12, 13: Xaa = Any Amino Acid
CCEYCCXNPXAXXCTGCY

SEQ ID NO: 1253 - protein, 18 aa, Artificial Sequence
  Synthetically generated peptide
  VARIANT 7, 10, 12, 14: Xaa = Any Amino Acid
CCEYCCXNPXAXCXTGCY

SEQ ID NO: 1254 - protein, 18 aa, Artificial Sequence
  Synthetically generated peptide
  VARIANT 7, 10, 12, 15: Xaa = Any Amino Acid
CCEYCCXNPXAXCTXGCY

SEQ ID NO: 1255 - protein, 18 aa, Artificial Sequence
  Synthetically generated peptide
  VARIANT 7, 10, 12, 16: Xaa = Any Amino Acid
CCEYCCXNPXAXCTGXCY

SEQ ID NO: 1256 - protein, 18 aa, Artificial Sequence
  Synthetically generated peptide
  VARIANT 7, 10, 12, 17: Xaa = Any Amino Acid
CCEYCCXNPXAXCTGCXY

SEQ ID NO: 1257 - protein, 17 aa, Artificial Sequence
  Synthetically generated peptide
  VARIANT 7, 10, 13: Xaa = Any Amino Acid
CCEYCCXNPXACXTGCY

SEQ ID NO: 1258 - protein, 18 aa, Artificial Sequence
  Synthetically generated peptide
  VARIANT 7, 10, 13, 14: Xaa = Any Amino Acid
CCEYCCXNPXACXXTGCY

SEQ ID NO: 1259 - protein, 18 aa, Artificial Sequence
  Synthetically generated peptide
  VARIANT 7, 10, 13, 15: Xaa = Any Amino Acid
CCEYCCXNPXACXTXGCY

SEQ ID NO: 1260 - protein, 18 aa, Artificial Sequence
  Synthetically generated peptide
  VARIANT 7, 10, 13, 16: Xaa = Any Amino Acid
CCEYCCXNPXACXTGXCY

SEQ ID NO: 1261 - protein, 18 aa, Artificial Sequence
  Synthetically generated peptide
  VARIANT 7, 10, 13, 17: Xaa = Any Amino Acid
CCEYCCXNPXACXTGCXY

SEQ ID NO: 1262 - protein, 17 aa, Artificial Sequence
  Synthetically generated peptide
  VARIANT 7, 10, 14: Xaa = Any Amino Acid
CCEYCCXNPXACTXGCY

SEQ ID NO: 1263 - protein, 18 aa, Artificial Sequence
  Synthetically generated peptide
  VARIANT 7, 10, 14, 15: Xaa = Any Amino Acid
CCEYCCXNPXACTXXGCY

SEQ ID NO: 1264 - protein, 18 aa, Artificial Sequence
  Synthetically generated peptide
  VARIANT 7, 10, 14, 16: Xaa = Any Amino Acid
CCEYCCXNPXACTXGXCY

SEQ ID NO: 1265 - protein, 18 aa, Artificial Sequence
  Synthetically generated peptide
  VARIANT 7, 10, 14, 17: Xaa = Any Amino Acid
CCEYCCXNPXACTXGCXY

SEQ ID NO: 1266 - protein, 17 aa, Artificial Sequence
  Synthetically generated peptide
  VARIANT 7, 10, 15: Xaa = Any Amino Acid
CCEYCCXNPXACTGXCY

SEQ ID NO: 1267 - protein, 18 aa, Artificial Sequence
  Synthetically generated peptide
  VARIANT 7, 10, 15, 16: Xaa = Any Amino Acid
CCEYCCXNPXACTGXXCY

SEQ ID NO: 1268 - protein, 18 aa, Artificial Sequence
  Synthetically generated peptide
  VARIANT 7, 10, 15, 17: Xaa = Any Amino Acid
CCEYCCXNPXACTGXCXY

SEQ ID NO: 1269 - protein, 17 aa, Artificial Sequence
  Synthetically generated peptide
  VARIANT 7, 10, 16: Xaa = Any Amino Acid
CCEYCCXNPXACTGCXY

SEQ ID NO: 1270 - protein, 18 aa, Artificial Sequence
  Synthetically generated peptide
  VARIANT 7, 10, 16, 17: Xaa = Any Amino Acid
CCEYCCXNPXACTGCXXY

SEQ ID NO: 1271 - protein, 16 aa, Artificial Sequence
  Synthetically generated peptide
  VARIANT 7, 11: Xaa = Any Amino Acid
CCEYCCXNPAXCTGCY

SEQ ID NO: 1272 - protein, 17 aa, Artificial Sequence
  Synthetically generated peptide
  VARIANT 7, 11, 12: Xaa = Any Amino Acid
CCEYCCXNPAXXCTGCY

SEQ ID NO: 1273 - protein, 18 aa, Artificial Sequence
  Synthetically generated peptide
  VARIANT 7, 11, 12, 13: Xaa = Any Amino Acid
CCEYCCXNPAXXXCTGCY

SEQ ID NO: 1274 - protein, 18 aa, Artificial Sequence
  Synthetically generated peptide
  VARIANT 7, 11, 12, 14: Xaa = Any Amino Acid
CCEYCCXNPAXXCXTGCY

SEQ ID NO: 1275 - protein, 18 aa, Artificial Sequence
  Synthetically generated peptide
  VARIANT 7, 11, 12, 15: Xaa = Any Amino Acid
CCEYCCXNPAXXCTXGCY

SEQ ID NO: 1276 - protein, 18 aa, Artificial Sequence
  Synthetically generated peptide
  VARIANT 7, 11, 12, 16: Xaa = Any Amino Acid
CCEYCCXNPAXXCTGXCY

SEQ ID NO: 1277 - protein, 18 aa, Artificial Sequence
  Synthetically generated peptide
  VARIANT 7, 11, 12, 17: Xaa = Any Amino Acid
CCEYCCXNPAXXCTGCXY

SEQ ID NO: 1278 - protein, 17 aa, Artificial Sequence
  Synthetically generated peptide
  VARIANT 7, 11, 13: Xaa = Any Amino Acid
CCEYCCXNPAXCXTGCY

SEQ ID NO: 1279 - protein, 18 aa, Artificial Sequence
  Synthetically generated peptide
  VARIANT 7, 11, 13, 14: Xaa = Any Amino Acid
CCEYCCXNPAXCXXTGCY

SEQ ID NO: 1280 - protein, 18 aa, Artificial Sequence
  Synthetically generated peptide
  VARIANT 7, 11, 13, 15: Xaa = Any Amino Acid
CCEYCCXNPAXCXTXGCY

SEQ ID NO: 1281 - protein, 18 aa, Artificial Sequence
  Synthetically generated peptide
  VARIANT 7, 11, 13, 16: Xaa = Any Amino Acid
CCEYCCXNPAXCXTGXCY

SEQ ID NO: 1282 - protein, 18 aa, Artificial Sequence
  Synthetically generated peptide
  VARIANT 7, 11, 13, 17: Xaa = Any Amino Acid
CCEYCCXNPAXCXTGCXY

SEQ ID NO: 1283 - protein, 17 aa, Artificial Sequence
  Synthetically generated peptide
  VARIANT 7, 11, 14: Xaa = Any Amino Acid
CCEYCCXNPAXCTXGCY

SEQ ID NO: 1284 - protein, 18 aa, Artificial Sequence
  Synthetically generated peptide
  VARIANT 7, 11, 14, 15: Xaa = Any Amino Acid
CCEYCCXNPAXCTXXGCY

SEQ ID NO: 1285 - protein, 18 aa, Artificial Sequence
  Synthetically generated peptide
  VARIANT 7, 11, 14, 16: Xaa = Any Amino Acid
CCEYCCXNPAXCTXGXCY

SEQ ID NO: 1286 - protein, 18 aa, Artificial Sequence
  Synthetically generated peptide
  VARIANT 7, 11, 14, 17: Xaa = Any Amino Acid
CCEYCCXNPAXCTXGCXY

SEQ ID NO: 1287 - protein, 17 aa, Artificial Sequence
  Synthetically generated peptide
  VARIANT 7, 11, 15: Xaa = Any Amino Acid
CCEYCCXNPAXCTGXCY

SEQ ID NO: 1288 - protein, 18 aa, Artificial Sequence
  Synthetically generated peptide
  VARIANT 7, 11, 15, 16: Xaa = Any Amino Acid
CCEYCCXNPAXCTGXXCY

SEQ ID NO: 1289 - protein, 18 aa, Artificial Sequence
  Synthetically generated peptide
  VARIANT 7, 11, 15, 17: Xaa = Any Amino Acid
CCEYCCXNPAXCTGXCXY

SEQ ID NO: 1290 - protein, 17 aa, Artificial Sequence
  Synthetically generated peptide
  VARIANT 7, 11, 16: Xaa = Any Amino Acid
CCEYCCXNPAXCTGCXY

SEQ ID NO: 1291 - protein, 18 aa, Artificial Sequence
  Synthetically generated peptide
  VARIANT 7, 11, 16, 17: Xaa = Any Amino Acid
CCEYCCXNPAXCTGCXXY

SEQ ID NO: 1292 - protein, 16 aa, Artificial Sequence
  Synthetically generated peptide
  VARIANT 7, 12: Xaa = Any Amino Acid
CCEYCCXNPACXTGCY

SEQ ID NO: 1293 - protein, 17 aa, Artificial Sequence
  Synthetically generated peptide
  VARIANT 7, 12, 13: Xaa = Any Amino Acid
CCEYCCXNPACXXTGCY

SEQ ID NO: 1294 - protein, 18 aa, Artificial Sequence
  Synthetically generated peptide
  VARIANT 7, 12, 13, 14: Xaa = Any Amino Acid
CCEYCCXNPACXXXTGCY

SEQ ID NO: 1295 - protein, 18 aa, Artificial Sequence
  Synthetically generated peptide
  VARIANT 7, 12, 13, 15: Xaa = Any Amino Acid
CCEYCCXNPACXXTXGCY

SEQ ID NO: 1296 - protein, 18 aa, Artificial Sequence
  Synthetically generated peptide
  VARIANT 7, 12, 13, 16: Xaa = Any Amino Acid
CCEYCCXNPACXXTGXCY

SEQ ID NO: 1297 - protein, 18 aa, Artificial Sequence
  Synthetically generated peptide
  VARIANT 7, 12, 13, 17: Xaa = Any Amino Acid
CCEYCCXNPACXXTGCXY

SEQ ID NO: 1298 - protein, 17 aa, Artificial Sequence
  Synthetically generated peptide
  VARIANT 7, 12, 14: Xaa = Any Amino Acid
CCEYCCXNPACXTXGCY

SEQ ID NO: 1299 - protein, 18 aa, Artificial Sequence
  Synthetically generated peptide
  VARIANT 7, 12, 14, 15: Xaa = Any Amino Acid
CCEYCCXNPACXTXXGCY

SEQ ID NO: 1300 - protein, 18 aa, Artificial Sequence
  Synthetically generated peptide
  VARIANT 7, 12, 14, 16: Xaa = Any Amino Acid
CCEYCCXNPACXTXGXCY

SEQ ID NO: 1301 - protein, 18 aa, Artificial Sequence
  Synthetically generated peptide
  VARIANT 7, 12, 14, 17: Xaa = Any Amino Acid
CCEYCCXNPACXTXGCXY

SEQ ID NO: 1302 - protein, 17 aa, Artificial Sequence
  Synthetically generated peptide
  VARIANT 7, 12, 15: Xaa = Any Amino Acid
CCEYCCXNPACXTGXCY

SEQ ID NO: 1303 - protein, 18 aa, Artificial Sequence
  Synthetically generated peptide
  VARIANT 7, 12, 15, 16: Xaa = Any Amino Acid
CCEYCCXNPACXTGXXCY

SEQ ID NO: 1304 - protein, 18 aa, Artificial Sequence
  Synthetically generated peptide
  VARIANT 7, 12, 15, 17: Xaa = Any Amino Acid
CCEYCCXNPACXTGXCXY

SEQ ID NO: 1305 - protein, 17 aa, Artificial Sequence
  Synthetically generated peptide
  VARIANT 7, 12, 16: Xaa = Any Amino Acid
CCEYCCXNPACXTGCXY

SEQ ID NO: 1306 - protein, 18 aa, Artificial Sequence
  Synthetically generated peptide
  VARIANT 7, 12, 16, 17: Xaa = Any Amino Acid
CCEYCCXNPACXTGCXXY

SEQ ID NO: 1307 - protein, 16 aa, Artificial Sequence
  Synthetically generated peptide
  VARIANT 7, 13: Xaa = Any Amino Acid
  VARIANT (1)...(16): Xaa = Any Amino Acid
CCEYCCXNPACTXGCY

SEQ ID NO: 1308 - protein, 17 aa, Artificial Sequence
  Synthetically generated peptide
  VARIANT 7, 13, 14: Xaa = Any Amino Acid
CCEYCCXNPACTXXGCY

SEQ ID NO: 1309 - protein, 18 aa, Artificial Sequence
  Synthetically generated peptide
  VARIANT 7, 13, 14, 15: Xaa = Any Amino Acid
CCEYCCXNPACTXXXGCY

SEQ ID NO: 1310 - protein, 18 aa, Artificial Sequence
  Synthetically generated peptide
  VARIANT 7, 13, 14, 16: Xaa = Any Amino Acid
CCEYCCXNPACTXXGXCY

SEQ ID NO: 1311 - protein, 18 aa, Artificial Sequence
  Synthetically generated peptide
  VARIANT 7, 13, 14, 17: Xaa = Any Amino Acid
CCEYCCXNPACTXXGCXY

SEQ ID NO: 1312 - protein, 17 aa, Artificial Sequence
  Synthetically generated peptide
  VARIANT 7, 13, 15: Xaa = Any Amino Acid
CCEYCCXNPACTXGXCY

SEQ ID NO: 1313 - protein, 18 aa, Artificial Sequence
  Synthetically generated peptide
  VARIANT 7, 13, 15, 16: Xaa = Any Amino Acid
CCEYCCXNPACTXGXXCY

SEQ ID NO: 1314 - protein, 18 aa, Artificial Sequence
  Synthetically generated peptide
  VARIANT 7, 13, 15, 17: Xaa = Any Amino Acid
CCEYCCXNPACTXGXCXY

SEQ ID NO: 1315 - protein, 17 aa, Artificial Sequence
  Synthetically generated peptide
  VARIANT 7, 13, 16: Xaa = Any Amino Acid
CCEYCCXNPACTXGCXY

SEQ ID NO: 1316 - protein, 18 aa, Artificial Sequence
  Synthetically generated peptide
  VARIANT 7, 13, 16, 17: Xaa = Any Amino Acid
CCEYCCXNPACTXGCXXY

SEQ ID NO: 1317 - protein, 16 aa, Artificial Sequence
  Synthetically generated peptide
  VARIANT 7, 14: Xaa = Any Amino Acid
CCEYCCXNPACTGXCY

SEQ ID NO: 1318 - protein, 17 aa, Artificial Sequence
  Synthetically generated peptide
  VARIANT 7, 14, 15: Xaa = Any Amino Acid
CCEYCCXNPACTGXXCY

SEQ ID NO: 1319 - protein, 18 aa, Artificial Sequence
  Synthetically generated peptide
  VARIANT 7, 14, 15, 16: Xaa = Any Amino Acid
CCEYCCXNPACTGXXXCY

SEQ ID NO: 1320 - protein, 18 aa, Artificial Sequence
  Synthetically generated peptide
  VARIANT 7, 14, 15, 17: Xaa = Any Amino Acid
CCEYCCXNPACTGXXCXY

SEQ ID NO: 1321 - protein, 17 aa, Artificial Sequence
  Synthetically generated peptide
  VARIANT 7, 14, 16: Xaa = Any Amino Acid
CCEYCCXNPACTGXCXY

SEQ ID NO: 1322 - protein, 18 aa, Artificial Sequence
  Synthetically generated peptide
  VARIANT 7, 14, 16, 17: Xaa = Any Amino Acid
CCEYCCXNPACTGXCXXY

SEQ ID NO: 1323 - protein, 16 aa, Artificial Sequence
  Synthetically generated peptide
  VARIANT 7, 15: Xaa = Any Amino Acid
CCEYCCXNPACTGCXY

SEQ ID NO: 1324 - protein, 17 aa, Artificial Sequence
  Synthetically generated peptide
  VARIANT 7, 15, 16: Xaa = Any Amino Acid
CCEYCCXNPACTGCXXY

SEQ ID NO: 1325 - protein, 18 aa, Artificial Sequence
  Synthetically generated peptide
  VARIANT 7, 15, 16, 17: Xaa = Any Amino Acid
CCEYCCXNPACTGCXXXY

SEQ ID NO: 1326 - protein, 15 aa, Artificial Sequence
  Synthetically generated peptide
  VARIANT 8: Xaa = Any Amino Acid
CCEYCCNXPACTGCY

SEQ ID NO: 1327 - protein, 16 aa, Artificial Sequence
  Synthetically generated peptide
  VARIANT 8, 9: Xaa = Any Amino Acid
CCEYCCNXXPACTGCY

SEQ ID NO: 1328 - protein, 17 aa, Artificial Sequence
  Synthetically generated peptide
  VARIANT 8, 9, 10: Xaa = Any Amino Acid
CCEYCCNXXXPACTGCY

SEQ ID NO: 1329 - protein, 18 aa, Artificial Sequence
  Synthetically generated peptide
  VARIANT 8, 9, 10 11: Xaa = Any Amino Acid
CCEYCCNXXXXPACTGCY

SEQ ID NO: 1330 - protein, 18 aa, Artificial Sequence
  Synthetically generated peptide
  VARIANT 8, 9, 10 12: Xaa = Any Amino Acid
CCEYCCNXXXPXACTGCY

SEQ ID NO: 1331 - protein, 18 aa, Artificial Sequence
  Synthetically generated peptide
  VARIANT 8, 9, 10 13: Xaa = Any Amino Acid
CCEYCCNXXXPAXCTGCY

SEQ ID NO: 1332 - protein, 18 aa, Artificial Sequence
  Synthetically generated peptide
  VARIANT 8, 9, 10 14: Xaa = Any Amino Acid
CCEYCCNXXXPACXTGCY

SEQ ID NO: 1333 - protein, 18 aa, Artificial Sequence
  Synthetically generated peptide
  VARIANT 8, 9, 10 15: Xaa = Any Amino Acid
CCEYCCNXXXPACTXGCY

SEQ ID NO: 1334 - protein, 18 aa, Artificial Sequence
  Synthetically generated peptide
  VARIANT 8, 9, 10 16: Xaa = Any Amino Acid
CCEYCCNXXXPACTGXCY

SEQ ID NO: 1335 - protein, 18 aa, Artificial Sequence
  Synthetically generated peptide
  VARIANT 8, 9, 10 17: Xaa = Any Amino Acid
CCEYCCNXXXPACTGCXY

SEQ ID NO: 1336 - protein, 17 aa, Artificial Sequence
  Synthetically generated peptide
  VARIANT 8, 9, 11: Xaa = Any Amino Acid
CCEYCCNXXPXACTGCY

SEQ ID NO: 1337 - protein, 18 aa, Artificial Sequence
  Synthetically generated peptide
  VARIANT 8, 9, 11, 12: Xaa = Any Amino Acid
CCEYCCNXXPXXACTGCY

SEQ ID NO: 1338 - protein, 18 aa, Artificial Sequence
  Synthetically generated peptide
  VARIANT 8, 9, 11, 13: Xaa = Any Amino Acid
CCEYCCNXXPXAXCTGCY

SEQ ID NO: 1339 - protein, 18 aa, Artificial Sequence
  Synthetically generated peptide
  VARIANT 8, 9, 11, 14: Xaa = Any Amino Acid
CCEYCCNXXPXACXTGCY

SEQ ID NO: 1340 - protein, 18 aa, Artificial Sequence
  Synthetically generated peptide
  VARIANT 8, 9, 11, 15: Xaa = Any Amino Acid
CCEYCCNXXPXACTXGCY

SEQ ID NO: 1341 - protein, 18 aa, Artificial Sequence
  Synthetically generated peptide
  VARIANT 8, 9, 11, 16: Xaa = Any Amino Acid
CCEYCCNXXPXACTGXCY

SEQ ID NO: 1342 - protein, 18 aa, Artificial Sequence
  Synthetically generated peptide
  VARIANT 8, 9, 11, 17: Xaa = Any Amino Acid
CCEYCCNXXPXACTGCXY

SEQ ID NO: 1343 - protein, 17 aa, Artificial Sequence
  Synthetically generated peptide
  VARIANT 8, 9, 12: Xaa = Any Amino Acid
CCEYCCNXXPAXCTGCY

SEQ ID NO: 1344 - protein, 18 aa, Artificial Sequence
  Synthetically generated peptide
  VARIANT 8, 9, 12, 13: Xaa = Any Amino Acid
CCEYCCNXXPAXXCTGCY

SEQ ID NO: 1345 - protein, 18 aa, Artificial Sequence
  Synthetically generated peptide
  VARIANT 8, 9, 12, 14: Xaa = Any Amino Acid
CCEYCCNXXPAXCXTGCY

SEQ ID NO: 1346 - protein, 18 aa, Artificial Sequence
  Synthetically generated peptide
  VARIANT 8, 9, 12, 15: Xaa = Any Amino Acid
CCEYCCNXXPAXCTXGCY

SEQ ID NO: 1347 - protein, 18 aa, Artificial Sequence
  Synthetically generated peptide
  VARIANT 8, 9, 12, 16: Xaa = Any Amino Acid
CCEYCCNXXPAXCTGXCY

SEQ ID NO: 1348 - protein, 18 aa, Artificial Sequence
  Synthetically generated peptide
  VARIANT 8, 9, 12, 17: Xaa = Any Amino Acid
CCEYCCNXXPAXCTGCXY

SEQ ID NO: 1349 - protein, 17 aa, Artificial Sequence
  Synthetically generated peptide
  VARIANT 8, 9, 13: Xaa = Any Amino Acid
CCEYCCNXXPACXTGCY

SEQ ID NO: 1350 - protein, 18 aa, Artificial Sequence
  Synthetically generated peptide
  VARIANT 8, 9, 13, 14: Xaa = Any Amino Acid
CCEYCCNXXPACXXTGCY

SEQ ID NO: 1351 - protein, 18 aa, Artificial Sequence
  Synthetically generated peptide
  VARIANT 8, 9, 13, 15: Xaa = Any Amino Acid
CCEYCCNXXPACXTXGCY

SEQ ID NO: 1352 - protein, 18 aa, Artificial Sequence
  Synthetically generated peptide
  VARIANT 8, 9, 13, 16: Xaa = Any Amino Acid
CCEYCCNXXPACXTGXCY

SEQ ID NO: 1353 - protein, 18 aa, Artificial Sequence
  Synthetically generated peptide
  VARIANT 8, 9, 13, 17: Xaa = Any Amino Acid
CCEYCCNXXPACXTGCXY

SEQ ID NO: 1354 - protein, 17 aa, Artificial Sequence
  Synthetically generated peptide
  VARIANT 8, 9, 14: Xaa = Any Amino Acid
CCEYCCNXXPACTXGCY

SEQ ID NO: 1355 - protein, 18 aa, Artificial Sequence
  Synthetically generated peptide
  VARIANT 8, 9, 14, 15: Xaa = Any Amino Acid
CCEYCCNXXPACTXXGCY

SEQ ID NO: 1356 - protein, 18 aa, Artificial Sequence
  Synthetically generated peptide
  VARIANT 8, 9, 14, 16: Xaa = Any Amino Acid
CCEYCCNXXPACTXGXCY

SEQ ID NO: 1357 - protein, 18 aa, Artificial Sequence
  Synthetically generated peptide
  VARIANT 8, 9, 14, 17: Xaa = Any Amino Acid
CCEYCCNXXPACTXGCXY

SEQ ID NO: 1358 - protein, 17 aa, Artificial Sequence
  Synthetically generated peptide
  VARIANT 8, 9, 15: Xaa = Any Amino Acid
CCEYCCNXXPACTGXCY

SEQ ID NO: 1359 - protein, 18 aa, Artificial Sequence
  Synthetically generated peptide
  VARIANT 8, 9, 15, 16: Xaa = Any Amino Acid
CCEYCCNXXPACTGXXCY

SEQ ID NO: 1360 - protein, 18 aa, Artificial Sequence
  Synthetically generated peptide
  VARIANT 8, 9, 15, 17: Xaa = Any Amino Acid
CCEYCCNXXPACTGXCXY

SEQ ID NO: 1361 - protein, 17 aa, Artificial Sequence
  Synthetically generated peptide
  VARIANT 8, 9, 16: Xaa = Any Amino Acid
CCEYCCNXXPACTGCXY

SEQ ID NO: 1362 - protein, 18 aa, Artificial Sequence
  Synthetically generated peptide
  VARIANT 8, 9, 16, 17: Xaa = Any Amino Acid
CCEYCCNXXPACTGCXXY

SEQ ID NO: 1363 - protein, 16 aa, Artificial Sequence
  Synthetically generated peptide
  VARIANT 8, 10: Xaa = Any Amino Acid
CCEYCCNXPXACTGCY

SEQ ID NO: 1364 - protein, 17 aa, Artificial Sequence
  Synthetically generated peptide
  VARIANT 8, 10, 11: Xaa = Any Amino Acid
CCEYCCNXPXXACTGCY

SEQ ID NO: 1365 - protein, 18 aa, Artificial Sequence
  Synthetically generated peptide
  VARIANT 8, 10, 11, 12: Xaa = Any Amino Acid
CCEYCCNXPXXXACTGCY

SEQ ID NO: 1366 - protein, 18 aa, Artificial Sequence
  Synthetically generated peptide
  VARIANT 8, 10, 11, 13: Xaa = Any Amino Acid
CCEYCCNXPXXAXCTGCY

SEQ ID NO: 1367 - protein, 18 aa, Artificial Sequence
  Synthetically generated peptide
  VARIANT 8, 10, 11, 14: Xaa = Any Amino Acid
CCEYCCNXPXXACXTGCY

SEQ ID NO: 1368 - protein, 18 aa, Artificial Sequence
  Synthetically generated peptide
  VARIANT 8, 10, 11, 15: Xaa = Any Amino Acid
CCEYCCNXPXXACTXGCY

SEQ ID NO: 1369 - protein, 18 aa, Artificial Sequence
  Synthetically generated peptide
  VARIANT 8, 10, 11, 16: Xaa = Any Amino Acid
CCEYCCNXPXXACTGXCY

SEQ ID NO: 1370 - protein, 18 aa, Artificial Sequence
  Synthetically generated peptide
  VARIANT 8, 10, 11, 17: Xaa = Any Amino Acid
CCEYCCNXPXXACTGCXY

SEQ ID NO: 1371 - protein, 17 aa, Artificial Sequence
  Synthetically generated peptide
  VARIANT 8, 10, 12: Xaa = Any Amino Acid
CCEYCCNXPXAXCTGCY

SEQ ID NO: 1372 - protein, 18 aa, Artificial Sequence
  Synthetically generated peptide
  VARIANT 8, 10, 12, 13: Xaa = Any Amino Acid
CCEYCCNXPXAXXCTGCY

SEQ ID NO: 1373 - protein, 18 aa, Artificial Sequence
  Synthetically generated peptide
  VARIANT 8, 10, 12, 14: Xaa = Any Amino Acid
CCEYCCNXPXAXCXTGCY

SEQ ID NO: 1374 - protein, 18 aa, Artificial Sequence
  Synthetically generated peptide
  VARIANT 8, 10, 12, 15: Xaa = Any Amino Acid
CCEYCCNXPXAXCTXGCY

SEQ ID NO: 1375 - protein, 18 aa, Artificial Sequence
  Synthetically generated peptide
  VARIANT 8, 10, 12, 16: Xaa = Any Amino Acid
CCEYCCNXPXAXCTGXCY

SEQ ID NO: 1376 - protein, 18 aa, Artificial Sequence
  Synthetically generated peptide
  VARIANT 8, 10, 12, 17: Xaa = Any Amino Acid
CCEYCCNXPXAXCTGCXY

SEQ ID NO: 1377 - protein, 17 aa, Artificial Sequence
  Synthetically generated peptide
  VARIANT 8, 10, 13: Xaa = Any Amino Acid
CCEYCCNXPXACXTGCY

SEQ ID NO: 1378 - protein, 18 aa, Artificial Sequence
  Synthetically generated peptide
  VARIANT 8, 10, 13, 14: Xaa = Any Amino Acid
CCEYCCNXPXACXXTGCY

SEQ ID NO: 1379 - protein, 18 aa, Artificial Sequence
  Synthetically generated peptide
  VARIANT 8, 10, 13, 15: Xaa = Any Amino Acid
CCEYCCNXPXACXTXGCY

SEQ ID NO: 1380 - protein, 18 aa, Artificial Sequence
  Synthetically generated peptide
  VARIANT 8, 10, 13, 16: Xaa = Any Amino Acid
CCEYCCNXPXACXTGXCY

SEQ ID NO: 1381 - protein, 18 aa, Artificial Sequence
  Synthetically generated peptide
  VARIANT 8, 10, 13, 17: Xaa = Any Amino Acid
CCEYCCNXPXACXTGCXY

SEQ ID NO: 1382 - protein, 17 aa, Artificial Sequence
  Synthetically generated peptide
  VARIANT 8, 10, 14: Xaa = Any Amino Acid
CCEYCCNXPXACTXGCY

SEQ ID NO: 1383 - protein, 18 aa, Artificial Sequence
  Synthetically generated peptide
  VARIANT 8, 10, 14, 15: Xaa = Any Amino Acid
CCEYCCNXPXACTXXGCY

SEQ ID NO: 1384 - protein, 18 aa, Artificial Sequence
  Synthetically generated peptide
  VARIANT 8, 10, 14, 16: Xaa = Any Amino Acid
CCEYCCNXPXACTXGXCY

SEQ ID NO: 1385 - protein, 18 aa, Artificial Sequence
  Synthetically generated peptide
  VARIANT 8, 10, 14, 17: Xaa = Any Amino Acid
CCEYCCNXPXACTXGCXY

SEQ ID NO: 1386 - protein, 17 aa, Artificial Sequence
  Synthetically generated peptide
  VARIANT 8, 10, 15: Xaa = Any Amino Acid
CCEYCCNXPXACTGXCY

SEQ ID NO: 1387 - protein, 18 aa, Artificial Sequence
  Synthetically generated peptide
  VARIANT 8, 10, 15, 16: Xaa = Any Amino Acid
CCEYCCNXPXACTGXXCY

SEQ ID NO: 1388 - protein, 18 aa, Artificial Sequence
  Synthetically generated peptide
  VARIANT 8, 10, 15, 17: Xaa = Any Amino Acid
CCEYCCNXPXACTGXCXY

SEQ ID NO: 1389 - protein, 17 aa, Artificial Sequence
  Synthetically generated peptide
  VARIANT 8, 10, 16: Xaa = Any Amino Acid
CCEYCCNXPXACTGCXY

SEQ ID NO: 1390 - protein, 18 aa, Artificial Sequence
  Synthetically generated peptide
  VARIANT 8, 10, 16, 17: Xaa = Any Amino Acid
CCEYCCNXPXACTGCXXY

SEQ ID NO: 1391 - protein, 16 aa, Artificial Sequence
  Synthetically generated peptide
  VARIANT 8, 11: Xaa = Any Amino Acid
CCEYCCNXPAXCTGCY

SEQ ID NO: 1392 - protein, 17 aa, Artificial Sequence
  Synthetically generated peptide
  VARIANT 8, 11, 12: Xaa = Any Amino Acid
CCEYCCNXPAXXCTGCY

SEQ ID NO: 1393 - protein, 18 aa, Artificial Sequence
  Synthetically generated peptide
  VARIANT 8, 11, 12, 13: Xaa = Any Amino Acid
CCEYCCNXPAXXXCTGCY

SEQ ID NO: 1394 - protein, 18 aa, Artificial Sequence
  Synthetically generated peptide
  VARIANT 8, 11, 12, 14: Xaa = Any Amino Acid
CCEYCCNXPAXXCXTGCY

SEQ ID NO: 1395 - protein, 18 aa, Artificial Sequence
  Synthetically generated peptide
  VARIANT 8, 11, 12, 15: Xaa = Any Amino Acid
CCEYCCNXPAXXCTXGCY

SEQ ID NO: 1396 - protein, 18 aa, Artificial Sequence
  Synthetically generated peptide
  VARIANT 8, 11, 12, 16: Xaa = Any Amino Acid
CCEYCCNXPAXXCTGXCY

SEQ ID NO: 1397 - protein, 18 aa, Artificial Sequence
  Synthetically generated peptide
  VARIANT 8, 11, 12, 17: Xaa = Any Amino Acid
CCEYCCNXPAXXCTGCXY

SEQ ID NO: 1398 - protein, 17 aa, Artificial Sequence
  Synthetically generated peptide
  VARIANT 8, 11, 13: Xaa = Any Amino Acid
CCEYCCNXPAXCXTGCY

SEQ ID NO: 1399 - protein, 18 aa, Artificial Sequence
  Synthetically generated peptide
  VARIANT 8, 11, 13, 14: Xaa = Any Amino Acid
CCEYCCNXPAXCXXTGCY

SEQ ID NO: 1400 - protein, 18 aa, Artificial Sequence
  Synthetically generated peptide
  VARIANT 8, 11, 13, 15: Xaa = Any Amino Acid
CCEYCCNXPAXCXTXGCY

SEQ ID NO: 1401 - protein, 18 aa, Artificial Sequence
  Synthetically generated peptide
  VARIANT 8, 11, 13, 16: Xaa = Any Amino Acid
CCEYCCNXPAXCXTGXCY

SEQ ID NO: 1402 - protein, 18 aa, Artificial Sequence
  Synthetically generated peptide
  VARIANT 8, 11, 13, 17: Xaa = Any Amino Acid
CCEYCCNXPAXCXTGCXY

SEQ ID NO: 1403 - protein, 17 aa, Artificial Sequence
  Synthetically generated peptide
  VARIANT 8, 11, 14: Xaa = Any Amino Acid
CCEYCCNXPAXCTXGCY

SEQ ID NO: 1404 - protein, 18 aa, Artificial Sequence
  Synthetically generated peptide
  VARIANT 8, 11, 14, 15: Xaa = Any Amino Acid
CCEYCCNXPAXCTXXGCY

SEQ ID NO: 1405 - protein, 18 aa, Artificial Sequence
  Synthetically generated peptide
  VARIANT 8, 11, 14, 16: Xaa = Any Amino Acid
CCEYCCNXPAXCTXGXCY

SEQ ID NO: 1406 - protein, 18 aa, Artificial Sequence
  Synthetically generated peptide
  VARIANT 8, 11, 14, 17: Xaa = Any Amino Acid
CCEYCCNXPAXCTXGCXY

SEQ ID NO: 1407 - protein, 17 aa, Artificial Sequence
  Synthetically generated peptide
  VARIANT 8, 11, 15: Xaa = Any Amino Acid
CCEYCCNXPAXCTGXCY

SEQ ID NO: 1408 - protein, 18 aa, Artificial Sequence
  Synthetically generated peptide
  VARIANT 8, 11, 15, 16: Xaa = Any Amino Acid
CCEYCCNXPAXCTGXXCY

SEQ ID NO: 1409 - protein, 18 aa, Artificial Sequence
  Synthetically generated peptide
  VARIANT 8, 11, 15, 17: Xaa = Any Amino Acid
CCEYCCNXPAXCTGXCXY

SEQ ID NO: 1410 - protein, 17 aa, Artificial Sequence
  Synthetically generated peptide
  VARIANT 8, 11, 16: Xaa = Any Amino Acid
CCEYCCNXPAXCTGCXY

SEQ ID NO: 1411 - protein, 18 aa, Artificial Sequence
  Synthetically generated peptide
  VARIANT 8, 11, 16, 17: Xaa = Any Amino Acid
CCEYCCNXPAXCTGCXXY

SEQ ID NO: 1412 - protein, 16 aa, Artificial Sequence
  Synthetically generated peptide
  VARIANT 8, 12: Xaa = Any Amino Acid
CCEYCCNXPACXTGCY

SEQ ID NO: 1413 - protein, 17 aa, Artificial Sequence
  Synthetically generated peptide
  VARIANT 8, 12, 13: Xaa = Any Amino Acid
CCEYCCNXPACXXTGCY

SEQ ID NO: 1414 - protein, 18 aa, Artificial Sequence
  Synthetically generated peptide
  VARIANT 8, 12, 13, 14: Xaa = Any Amino Acid
CCEYCCNXPACXXXTGCY

SEQ ID NO: 1415 - protein, 18 aa, Artificial Sequence
  Synthetically generated peptide
  VARIANT 8, 12, 13, 15: Xaa = Any Amino Acid
CCEYCCNXPACXXTXGCY

SEQ ID NO: 1416 - protein, 18 aa, Artificial Sequence
  Synthetically generated peptide
  VARIANT 8, 12, 13, 16: Xaa = Any Amino Acid
CCEYCCNXPACXXTGXCY

SEQ ID NO: 1417 - protein, 18 aa, Artificial Sequence
  Synthetically generated peptide
  VARIANT 8, 12, 13, 17: Xaa = Any Amino Acid
CCEYCCNXPACXXTGCXY

SEQ ID NO: 1418 - protein, 17 aa, Artificial Sequence
  Synthetically generated peptide
  VARIANT 8, 12, 14: Xaa = Any Amino Acid
CCEYCCNXPACXTXGCY

SEQ ID NO: 1419 - protein, 18 aa, Artificial Sequence
  Synthetically generated peptide
  VARIANT 8, 12, 14, 15: Xaa = Any Amino Acid
CCEYCCNXPACXTXXGCY

SEQ ID NO: 1420 - protein, 18 aa, Artificial Sequence
  Synthetically generated peptide
  VARIANT 8, 12, 14, 16: Xaa = Any Amino Acid
CCEYCCNXPACXTXGXCY

SEQ ID NO: 1421 - protein, 18 aa, Artificial Sequence
  Synthetically generated peptide
  VARIANT 8, 12, 14, 17: Xaa = Any Amino Acid
CCEYCCNXPACXTXGCXY

SEQ ID NO: 1422 - protein, 17 aa, Artificial Sequence
  Synthetically generated peptide
  VARIANT 8, 12, 15: Xaa = Any Amino Acid
CCEYCCNXPACXTGXCY

SEQ ID NO: 1423 - protein, 18 aa, Artificial Sequence
  Synthetically generated peptide
  VARIANT 8, 12, 15, 16: Xaa = Any Amino Acid
CCEYCCNXPACXTGXXCY

SEQ ID NO: 1424 - protein, 18 aa, Artificial Sequence
  Synthetically generated peptide
  VARIANT 8, 12, 15, 17: Xaa = Any Amino Acid
CCEYCCNXPACXTGXCXY

SEQ ID NO: 1425 - protein, 17 aa, Artificial Sequence
  Synthetically generated peptide
  VARIANT 8, 12, 16: Xaa = Any Amino Acid
CCEYCCNXPACXTGCXY

SEQ ID NO: 1426 - protein, 18 aa, Artificial Sequence
  Synthetically generated peptide
  VARIANT 8, 12, 16, 17: Xaa = Any Amino Acid
CCEYCCNXPACXTGCXXY

SEQ ID NO: 1427 - protein, 16 aa, Artificial Sequence
  Synthetically generated peptide
  VARIANT 8, 13: Xaa = Any Amino Acid
CCEYCCNXPACTXGCY

SEQ ID NO: 1428 - protein, 17 aa, Artificial Sequence
  Synthetically generated peptide
  VARIANT 8, 13, 14: Xaa = Any Amino Acid
CCEYCCNXPACTXXGCY

SEQ ID NO: 1429 - protein, 18 aa, Artificial Sequence
  Synthetically generated peptide
  VARIANT 8, 13, 14, 15: Xaa = Any Amino Acid
CCEYCCNXPACTXXXGCY

SEQ ID NO: 1430 - protein, 18 aa, Artificial Sequence
  Synthetically generated peptide
  VARIANT 8, 13, 14, 16: Xaa = Any Amino Acid
CCEYCCNXPACTXXGXCY

SEQ ID NO: 1431 - protein, 18 aa, Artificial Sequence
  Synthetically generated peptide
  VARIANT 8, 13, 14, 17: Xaa = Any Amino Acid
CCEYCCNXPACTXXGCXY

SEQ ID NO: 1432 - protein, 17 aa, Artificial Sequence
  Synthetically generated peptide
  VARIANT 8, 13, 15: Xaa = Any Amino Acid
CCEYCCNXPACTXGXCY

SEQ ID NO: 1433 - protein, 18 aa, Artificial Sequence
  Synthetically generated peptide
  VARIANT 8, 13, 15, 16: Xaa = Any Amino Acid
CCEYCCNXPACTXGXXCY

SEQ ID NO: 1434 - protein, 18 aa, Artificial Sequence
  Synthetically generated peptide
  VARIANT 8, 13, 15, 17: Xaa = Any Amino Acid
CCEYCCNXPACTXGXCXY

SEQ ID NO: 1435 - protein, 17 aa, Artificial Sequence
  Synthetically generated peptide
  VARIANT 8, 13, 16: Xaa = Any Amino Acid
CCEYCCNXPACTXGCXY

SEQ ID NO: 1436 - protein, 18 aa, Artificial Sequence
  Synthetically generated peptide
  VARIANT 8, 13, 16, 17: Xaa = Any Amino Acid
CCEYCCNXPACTXGCXXY

SEQ ID NO: 1437 - protein, 16 aa, Artificial Sequence
  Synthetically generated peptide
  VARIANT 8, 14: Xaa = Any Amino Acid
CCEYCCNXPACTGXCY

SEQ ID NO: 1438 - protein, 17 aa, Artificial Sequence
  Synthetically generated peptide
  VARIANT 8, 14, 15: Xaa = Any Amino Acid
CCEYCCNXPACTGXXCY

SEQ ID NO: 1439 - protein, 18 aa, Artificial Sequence
  Synthetically generated peptide
  VARIANT 8, 14, 15, 16: Xaa = Any Amino Acid
CCEYCCNXPACTGXXXCY

SEQ ID NO: 1440 - protein, 18 aa, Artificial Sequence
  Synthetically generated peptide
  VARIANT 8, 14, 15, 17: Xaa = Any Amino Acid
CCEYCCNXPACTGXXCXY

SEQ ID NO: 1441 - protein, 17 aa, Artificial Sequence
  Synthetically generated peptide
  VARIANT 8, 14, 16: Xaa = Any Amino Acid
CCEYCCNXPACTGXCXY

SEQ ID NO: 1442 - protein, 18 aa, Artificial Sequence
  Synthetically generated peptide
  VARIANT 8, 14, 16, 17: Xaa = Any Amino Acid
CCEYCCNXPACTGXCXXY

SEQ ID NO: 1443 - protein, 16 aa, Artificial Sequence
  Synthetically generated peptide
  VARIANT 8, 15,: Xaa = Any Amino Acid
CCEYCCNXPACTGCXY

SEQ ID NO: 1444 - protein, 17 aa, Artificial Sequence
  Synthetically generated peptide
  VARIANT 8, 15, 16: Xaa = Any Amino Acid
CCEYCCNXPACTGCXXY

SEQ ID NO: 1445 - protein, 18 aa, Artificial Sequence
  Synthetically generated peptide
  VARIANT 8, 15, 16, 17: Xaa = Any Amino Acid
CCEYCCNXPACTGCXXXY

SEQ ID NO: 1446 - protein, 15 aa, Artificial Sequence
  Synthetically generated peptide
  VARIANT 9: Xaa = Any Amino Acid
CCEYCCNPXACTGCY

SEQ ID NO: 1447 - protein, 16 aa, Artificial Sequence
  Synthetically generated peptide
  VARIANT 9, 10: Xaa = Any Amino Acid
CCEYCCNPXXACTGCY

SEQ ID NO: 1448 - protein, 17 aa, Artificial Sequence
  Synthetically generated peptide
  VARIANT 9, 10, 11: Xaa = Any Amino Acid
CCEYCCNPXXXACTGCY

SEQ ID NO: 1449 - protein, 18 aa, Artificial Sequence
  Synthetically generated peptide
  VARIANT 9, 10, 11, 12: Xaa = Any Amino Acid
CCEYCCNPXXXXACTGCY

SEQ ID NO: 1450 - protein, 18 aa, Artificial Sequence
  Synthetically generated peptide
  VARIANT 9, 10, 11, 13: Xaa = Any Amino Acid
CCEYCCNPXXXAXCTGCY

SEQ ID NO: 1451 - protein, 18 aa, Artificial Sequence
  Synthetically generated peptide
  VARIANT 9, 10, 11, 14: Xaa = Any Amino Acid
CCEYCCNPXXXACXTGCY

SEQ ID NO: 1452 - protein, 18 aa, Artificial Sequence
  Synthetically generated peptide
  VARIANT 9, 10, 11, 15: Xaa = Any Amino Acid
CCEYCCNPXXXACTXGCY

SEQ ID NO: 1453 - protein, 18 aa, Artificial Sequence
  Synthetically generated peptide
  VARIANT 9, 10, 11, 16: Xaa = Any Amino Acid
CCEYCCNPXXXACTGXCY

SEQ ID NO: 1454 - protein, 18 aa, Artificial Sequence
  Synthetically generated peptide
  VARIANT 9, 10, 11, 17: Xaa = Any Amino Acid
CCEYCCNPXXXACTGCXY

SEQ ID NO: 1455 - protein, 17 aa, Artificial Sequence
  Synthetically generated peptide
  VARIANT 9, 10, 12: Xaa = Any Amino Acid
CCEYCCNPXXAXCTGCY

SEQ ID NO: 1456 - protein, 18 aa, Artificial Sequence
  Synthetically generated peptide
  VARIANT 9, 10, 12, 13: Xaa = Any Amino Acid
CCEYCCNPXXAXXCTGCY

SEQ ID NO: 1457 - protein, 18 aa, Artificial Sequence
  Synthetically generated peptide
  VARIANT 9, 10, 12, 14: Xaa = Any Amino Acid
CCEYCCNPXXAXCXTGCY

SEQ ID NO: 1458 - protein, 18 aa, Artificial Sequence
  Synthetically generated peptide
  VARIANT 9, 10, 12, 15: Xaa = Any Amino Acid
CCEYCCNPXXAXCTXGCY

SEQ ID NO: 1459 - protein, 18 aa, Artificial Sequence
  Synthetically generated peptide
  VARIANT 9, 10, 12, 16: Xaa = Any Amino Acid
CCEYCCNPXXAXCTGXCY

SEQ ID NO: 1460 - protein, 18 aa, Artificial Sequence
  Synthetically generated peptide
  VARIANT 9, 10, 12, 17: Xaa = Any Amino Acid
CCEYCCNPXXAXCTGCXY

SEQ ID NO: 1461 - protein, 17 aa, Artificial Sequence
  Synthetically generated peptide
  VARIANT 9, 10, 13: Xaa = Any Amino Acid
CCEYCCNPXXACXTGCY

SEQ ID NO: 1462 - protein, 18 aa, Artificial Sequence
  Synthetically generated peptide
  VARIANT 9, 10, 13, 14: Xaa = Any Amino Acid
CCEYCCNPXXACXXTGCY

SEQ ID NO: 1463 - protein, 18 aa, Artificial Sequence
  Synthetically generated peptide
  VARIANT 9, 10, 13, 15: Xaa = Any Amino Acid
CCEYCCNPXXACXTXGCY

SEQ ID NO: 1464 - protein, 18 aa, Artificial Sequence
  Synthetically generated peptide
  VARIANT 9, 10, 13, 16: Xaa = Any Amino Acid
CCEYCCNPXXACXTGXCY

SEQ ID NO: 1465 - protein, 18 aa, Artificial Sequence
  Synthetically generated peptide
  VARIANT 9, 10, 13, 17: Xaa = Any Amino Acid
CCEYCCNPXXACXTGCXY

SEQ ID NO: 1466 - protein, 17 aa, Artificial Sequence
  Synthetically generated peptide
  VARIANT 9, 10, 14: Xaa = Any Amino Acid
CCEYCCNPXXACTXGCY

SEQ ID NO: 1467 - protein, 18 aa, Artificial Sequence
  Synthetically generated peptide
  VARIANT 9, 10, 14, 15: Xaa = Any Amino Acid
CCEYCCNPXXACTXXGCY

SEQ ID NO: 1468 - protein, 18 aa, Artificial Sequence
  Synthetically generated peptide
  VARIANT 9, 10, 14, 16: Xaa = Any Amino Acid
CCEYCCNPXXACTXGXCY

SEQ ID NO: 1469 - protein, 18 aa, Artificial Sequence
  Synthetically generated peptide
  VARIANT 9, 10, 14, 17: Xaa = Any Amino Acid
CCEYCCNPXXACTXGCXY

SEQ ID NO: 1470 - protein, 17 aa, Artificial Sequence
  Synthetically generated peptide
  VARIANT 9, 10, 15: Xaa = Any Amino Acid
CCEYCCNPXXACTGXCY

SEQ ID NO: 1471 - protein, 18 aa, Artificial Sequence
  Synthetically generated peptide
  VARIANT 9, 10, 15, 16: Xaa = Any Amino Acid
CCEYCCNPXXACTGXXCY

SEQ ID NO: 1472 - protein, 18 aa, Artificial Sequence
  Synthetically generated peptide
  VARIANT 9, 10, 15, 17: Xaa = Any Amino Acid
CCEYCCNPXXACTGXCXY

SEQ ID NO: 1473 - protein, 17 aa, Artificial Sequence
  Synthetically generated peptide
  VARIANT 9, 10, 16: Xaa = Any Amino Acid
CCEYCCNPXXACTGCXY

SEQ ID NO: 1474 - protein, 18 aa, Artificial Sequence
  Synthetically generated peptide
  VARIANT 9, 10, 16, 17: Xaa = Any Amino Acid
CCEYCCNPXXACTGCXXY

SEQ ID NO: 1475 - protein, 16 aa, Artificial Sequence
  Synthetically generated peptide
  VARIANT 9, 11: Xaa = Any Amino Acid
  VARIANT (1)...(16): Xaa = Any Amino Acid
CCEYCCNPXAXCTGCY

SEQ ID NO: 1476 - protein, 17 aa, Artificial Sequence
  Synthetically generated peptide
  VARIANT 9, 11, 12: Xaa = Any Amino Acid
CCEYCCNPXAXXCTGCY

SEQ ID NO: 1477 - protein, 18 aa, Artificial Sequence
  Synthetically generated peptide
  VARIANT 9, 11, 12, 13: Xaa = Any Amino Acid
CCEYCCNPXAXXXCTGCY

SEQ ID NO: 1478 - protein, 18 aa, Artificial Sequence
  Synthetically generated peptide
  VARIANT 9, 11, 12, 14: Xaa = Any Amino Acid
CCEYCCNPXAXXCXTGCY

SEQ ID NO: 1479 - protein, 18 aa, Artificial Sequence
  Synthetically generated peptide
  VARIANT 9, 11, 12, 15: Xaa = Any Amino Acid
CCEYCCNPXAXXCTXGCY

SEQ ID NO: 1480 - protein, 18 aa, Artificial Sequence
  Synthetically generated peptide
  VARIANT 9, 11, 12, 16: Xaa = Any Amino Acid
CCEYCCNPXAXXCTGXCY

SEQ ID NO: 1481 - protein, 18 aa, Artificial Sequence
  Synthetically generated peptide
  VARIANT 9, 11, 12, 17: Xaa = Any Amino Acid
CCEYCCNPXAXXCTGCXY

SEQ ID NO: 1482 - protein, 17 aa, Artificial Sequence
  Synthetically generated peptide
  VARIANT 9, 11, 13: Xaa = Any Amino Acid
CCEYCCNPXAXCXTGCY

SEQ ID NO: 1483 - protein, 18 aa, Artificial Sequence
  Synthetically generated peptide
  VARIANT 9, 11, 13, 14: Xaa = Any Amino Acid
CCEYCCNPXAXCXXTGCY

SEQ ID NO: 1484 - protein, 18 aa, Artificial Sequence
  Synthetically generated peptide
  VARIANT 9, 11, 13, 15: Xaa = Any Amino Acid
CCEYCCNPXAXCXTXGCY

SEQ ID NO: 1485 - protein, 18 aa, Artificial Sequence
  Synthetically generated peptide
  VARIANT 9, 11, 13, 16: Xaa = Any Amino Acid
CCEYCCNPXAXCXTGXCY

SEQ ID NO: 1486 - protein, 18 aa, Artificial Sequence
  Synthetically generated peptide
  VARIANT 9, 11, 13, 17: Xaa = Any Amino Acid
CCEYCCNPXAXCXTGCXY

SEQ ID NO: 1487 - protein, 17 aa, Artificial Sequence
  Synthetically generated peptide
  VARIANT 9, 11, 14: Xaa = Any Amino Acid
CCEYCCNPXAXCTXGCY

SEQ ID NO: 1488 - protein, 18 aa, Artificial Sequence
  Synthetically generated peptide
  VARIANT 9, 11, 14, 15: Xaa = Any Amino Acid
CCEYCCNPXAXCTXXGCY

SEQ ID NO: 1489 - protein, 18 aa, Artificial Sequence
  Synthetically generated peptide
  VARIANT 9, 11, 14, 16: Xaa = Any Amino Acid
CCEYCCNPXAXCTXGXCY

SEQ ID NO: 1490 - protein, 18 aa, Artificial Sequence
  Synthetically generated peptide
  VARIANT 9, 11, 14, 17: Xaa = Any Amino Acid
CCEYCCNPXAXCTXGCXY

SEQ ID NO: 1491 - protein, 17 aa, Artificial Sequence
  Synthetically generated peptide
  VARIANT 9, 11, 15: Xaa = Any Amino Acid
CCEYCCNPXAXCTGXCY

SEQ ID NO: 1492 - protein, 18 aa, Artificial Sequence
  Synthetically generated peptide
  VARIANT 9, 11, 15, 16: Xaa = Any Amino Acid
CCEYCCNPXAXCTGXXCY

SEQ ID NO: 1493 - protein, 18 aa, Artificial Sequence
  Synthetically generated peptide
  VARIANT 9, 11, 15, 17: Xaa = Any Amino Acid
CCEYCCNPXAXCTGXCXY

SEQ ID NO: 1494 - protein, 17 aa, Artificial Sequence
  Synthetically generated peptide
  VARIANT 9, 11, 16: Xaa = Any Amino Acid
CCEYCCNPXAXCTGCXY

SEQ ID NO: 1495 - protein, 18 aa, Artificial Sequence
  Synthetically generated peptide
  VARIANT 9, 11, 16, 17: Xaa = Any Amino Acid
CCEYCCNPXAXCTGCXXY

SEQ ID NO: 1496 - protein, 16 aa, Artificial Sequence
  Synthetically generated peptide
  VARIANT 9, 12: Xaa = Any Amino Acid
CCEYCCNPXACXTGCY

SEQ ID NO: 1497 - protein, 17 aa, Artificial Sequence
  Synthetically generated peptide
  VARIANT 9, 12, 13: Xaa = Any Amino Acid
CCEYCCNPXACXXTGCY

SEQ ID NO: 1498 - protein, 18 aa, Artificial Sequence
  Synthetically generated peptide
  VARIANT 9, 12, 13, 14: Xaa = Any Amino Acid
CCEYCCNPXACXXXTGCY

SEQ ID NO: 1499 - protein, 18 aa, Artificial Sequence
  Synthetically generated peptide
  VARIANT 9, 12, 13, 15: Xaa = Any Amino Acid
CCEYCCNPXACXXTXGCY

SEQ ID NO: 1500 - protein, 18 aa, Artificial Sequence
  Synthetically generated peptide
  VARIANT 9, 12, 13, 16: Xaa = Any Amino Acid
CCEYCCNPXACXXTGXCY

SEQ ID NO: 1501 - protein, 18 aa, Artificial Sequence
  Synthetically generated peptide
  VARIANT 9, 12, 13, 17: Xaa = Any Amino Acid
CCEYCCNPXACXXTGCXY

SEQ ID NO: 1502 - protein, 17 aa, Artificial Sequence
  Synthetically generated peptide
  VARIANT 9, 12, 14: Xaa = Any Amino Acid
CCEYCCNPXACXTXGCY

SEQ ID NO: 1503 - protein, 18 aa, Artificial Sequence
  Synthetically generated peptide
  VARIANT 9, 12, 14, 15: Xaa = Any Amino Acid
CCEYCCNPXACXTXXGCY

SEQ ID NO: 1504 - protein, 18 aa, Artificial Sequence
  Synthetically generated peptide
  VARIANT 9, 12, 14, 16: Xaa = Any Amino Acid
CCEYCCNPXACXTXGXCY

SEQ ID NO: 1505 - protein, 18 aa, Artificial Sequence
  Synthetically generated peptide
  VARIANT 9, 12, 14, 17: Xaa = Any Amino Acid
CCEYCCNPXACXTXGCXY

SEQ ID NO: 1506 - protein, 17 aa, Artificial Sequence
  Synthetically generated peptide
  VARIANT 9, 12, 15: Xaa = Any Amino Acid
CCEYCCNPXACXTGXCY

SEQ ID NO: 1507 - protein, 18 aa, Artificial Sequence
  Synthetically generated peptide
  VARIANT 9, 12, 15, 16: Xaa = Any Amino Acid
CCEYCCNPXACXTGXXCY

SEQ ID NO: 1508 - protein, 18 aa, Artificial Sequence
  Synthetically generated peptide
  VARIANT 9, 12, 15, 17: Xaa = Any Amino Acid
CCEYCCNPXACXTGXCXY

SEQ ID NO: 1509 - protein, 17 aa, Artificial Sequence
  Synthetically generated peptide
  VARIANT 9, 12, 16: Xaa = Any Amino Acid
CCEYCCNPXACXTGCXY

SEQ ID NO: 1510 - protein, 18 aa, Artificial Sequence
  Synthetically generated peptide
  VARIANT 9, 12, 16, 17: Xaa = Any Amino Acid
CCEYCCNPXACXTGCXXY

SEQ ID NO: 1511 - protein, 16 aa, Artificial Sequence
  Synthetically generated peptide
  VARIANT 9, 13: Xaa = Any Amino Acid
CCEYCCNPXACTXGCY

SEQ ID NO: 1512 - protein, 17 aa, Artificial Sequence
  Synthetically generated peptide
  VARIANT 9, 13, 14: Xaa = Any Amino Acid
CCEYCCNPXACTXXGCY

SEQ ID NO: 1513 - protein, 18 aa, Artificial Sequence
  Synthetically generated peptide
  VARIANT 9, 13, 14, 15: Xaa = Any Amino Acid
CCEYCCNPXACTXXXGCY

SEQ ID NO: 1514 - protein, 18 aa, Artificial Sequence
  Synthetically generated peptide
  VARIANT 9, 13, 14, 16: Xaa = Any Amino Acid
CCEYCCNPXACTXXGXCY

SEQ ID NO: 1515 - protein, 18 aa, Artificial Sequence
  Synthetically generated peptide
  VARIANT 9, 13, 14, 17: Xaa = Any Amino Acid
CCEYCCNPXACTXXGCXY

SEQ ID NO: 1516 - protein, 17 aa, Artificial Sequence
  Synthetically generated peptide
  VARIANT 9, 13, 15: Xaa = Any Amino Acid
CCEYCCNPXACTXGXCY

SEQ ID NO: 1517 - protein, 18 aa, Artificial Sequence
  Synthetically generated peptide
  VARIANT 9, 13, 15, 16: Xaa = Any Amino Acid
CCEYCCNPXACTXGXXCY

SEQ ID NO: 1518 - protein, 18 aa, Artificial Sequence
  Synthetically generated peptide
  VARIANT 9, 13, 15, 17: Xaa = Any Amino Acid
CCEYCCNPXACTXGXCXY

SEQ ID NO: 1519 - protein, 17 aa, Artificial Sequence
  Synthetically generated peptide
  VARIANT 9, 13, 16: Xaa = Any Amino Acid
CCEYCCNPXACTXGCXY

SEQ ID NO: 1520 - protein, 18 aa, Artificial Sequence
  Synthetically generated peptide
  VARIANT 9, 13, 16, 17: Xaa = Any Amino Acid
CCEYCCNPXACTXGCXXY

SEQ ID NO: 1521 - protein, 16 aa, Artificial Sequence
  Synthetically generated peptide
  VARIANT 9, 14: Xaa = Any Amino Acid
  VARIANT (1)...(16): Xaa = Any Amino Acid
CCEYCCNPXACTGXCY

SEQ ID NO: 1522 - protein, 17 aa, Artificial Sequence
  Synthetically generated peptide
  VARIANT 9, 14, 15: Xaa = Any Amino Acid
CCEYCCNPXACTGXXCY

SEQ ID NO: 1523 - protein, 18 aa, Artificial Sequence
  Synthetically generated peptide
  VARIANT 9, 14, 15, 16: Xaa = Any Amino Acid
CCEYCCNPXACTGXXXCY

SEQ ID NO: 1524 - protein, 18 aa, Artificial Sequence
  Synthetically generated peptide
  VARIANT 9, 14, 15, 17: Xaa = Any Amino Acid
CCEYCCNPXACTGXXCXY

SEQ ID NO: 1525 - protein, 17 aa, Artificial Sequence
  Synthetically generated peptide
  VARIANT 9, 14, 16: Xaa = Any Amino Acid
CCEYCCNPXACTGXCXY

SEQ ID NO: 1526 - protein, 18 aa, Artificial Sequence
  Synthetically generated peptide
  VARIANT 9, 14, 16, 17: Xaa = Any Amino Acid
CCEYCCNPXACTGXCXXY

SEQ ID NO: 1527 - protein, 16 aa, Artificial Sequence
  Synthetically generated peptide
  VARIANT 9, 15: Xaa = Any Amino Acid
CCEYCCNPXACTGCXY

SEQ ID NO: 1528 - protein, 17 aa, Artificial Sequence
  Synthetically generated peptide
  VARIANT 9, 15, 16: Xaa = Any Amino Acid
CCEYCCNPXACTGCXXY

SEQ ID NO: 1529 - protein, 18 aa, Artificial Sequence
  Synthetically generated peptide
  VARIANT 9, 15, 16, 17: Xaa = Any Amino Acid
CCEYCCNPXACTGCXXXY

SEQ ID NO: 1530 - protein, 15 aa, Artificial Sequence
  Synthetically generated peptide
  VARIANT 10: Xaa = Any Amino Acid
CCEYCCNPAXCTGCY

SEQ ID NO: 1531 - protein, 16 aa, Artificial Sequence
  Synthetically generated peptide
  VARIANT 10, 11: Xaa = Any Amino Acid
CCEYCCNPAXXCTGCY

SEQ ID NO: 1532 - protein, 17 aa, Artificial Sequence
  Synthetically generated peptide
  VARIANT 10, 11, 12: Xaa = Any Amino Acid
CCEYCCNPAXXXCTGCY

SEQ ID NO: 1533 - protein, 18 aa, Artificial Sequence
  Synthetically generated peptide
  VARIANT 10, 11, 12, 13: Xaa = Any Amino Acid
CCEYCCNPAXXXXCTGCY

SEQ ID NO: 1534 - protein, 18 aa, Artificial Sequence
  Synthetically generated peptide
  VARIANT 10, 11, 12, 14: Xaa = Any Amino Acid
CCEYCCNPAXXXCXTGCY

SEQ ID NO: 1535 - protein, 18 aa, Artificial Sequence
  Synthetically generated peptide
  VARIANT 10, 11, 12, 15: Xaa = Any Amino Acid
CCEYCCNPAXXXCTXGCY

SEQ ID NO: 1536 - protein, 18 aa, Artificial Sequence
  Synthetically generated peptide
  VARIANT 10, 11, 12, 16: Xaa = Any Amino Acid
CCEYCCNPAXXXCTGXCY

SEQ ID NO: 1537 - protein, 18 aa, Artificial Sequence
  Synthetically generated peptide
  VARIANT 10, 11, 12, 17: Xaa = Any Amino Acid
CCEYCCNPAXXXCTGCXY

SEQ ID NO: 1538 - protein, 17 aa, Artificial Sequence
  Synthetically generated peptide
  VARIANT 10, 11, 13: Xaa = Any Amino Acid
CCEYCCNPAXXCXTGCY

SEQ ID NO: 1539 - protein, 18 aa, Artificial Sequence
  Synthetically generated peptide
  VARIANT 10, 11, 13, 14: Xaa = Any Amino Acid
CCEYCCNPAXXCXXTGCY

SEQ ID NO: 1540 - protein, 18 aa, Artificial Sequence
  Synthetically generated peptide
  VARIANT 10, 11, 13, 15: Xaa = Any Amino Acid
CCEYCCNPAXXCXTXGCY

SEQ ID NO: 1541 - protein, 18 aa, Artificial Sequence
  Synthetically generated peptide
  VARIANT 10, 11, 13, 16: Xaa = Any Amino Acid
CCEYCCNPAXXCXTGXCY

SEQ ID NO: 1542 - protein, 18 aa, Artificial Sequence
  Synthetically generated peptide
  VARIANT 10, 11, 13, 17: Xaa = Any Amino Acid
CCEYCCNPAXXCXTGCXY

SEQ ID NO: 1543 - protein, 17 aa, Artificial Sequence
  Synthetically generated peptide
  VARIANT 10, 11, 14: Xaa = Any Amino Acid
CCEYCCNPAXXCTXGCY

SEQ ID NO: 1544 - protein, 18 aa, Artificial Sequence
  Synthetically generated peptide
  VARIANT 10, 11, 14, 15: Xaa = Any Amino Acid
CCEYCCNPAXXCTXXGCY

SEQ ID NO: 1545 - protein, 18 aa, Artificial Sequence
  Synthetically generated peptide
  VARIANT 10, 11, 14, 16: Xaa = Any Amino Acid
CCEYCCNPAXXCTXGXCY

SEQ ID NO: 1546 - protein, 18 aa, Artificial Sequence
  Synthetically generated peptide
  VARIANT 10, 11, 14, 17: Xaa = Any Amino Acid
CCEYCCNPAXXCTXGCXY

SEQ ID NO: 1547 - protein, 17 aa, Artificial Sequence
  Synthetically generated peptide
  VARIANT 10, 11, 15: Xaa = Any Amino Acid
CCEYCCNPAXXCTGXCY

SEQ ID NO: 1548 - protein, 18 aa, Artificial Sequence
  Synthetically generated peptide
  VARIANT 10, 11, 15, 16: Xaa = Any Amino Acid
CCEYCCNPAXXCTGXXCY

SEQ ID NO: 1549 - protein, 18 aa, Artificial Sequence
  Synthetically generated peptide
  VARIANT 10, 11, 15, 17: Xaa = Any Amino Acid
CCEYCCNPAXXCTGXCXY

SEQ ID NO: 1550 - protein, 17 aa, Artificial Sequence
  Synthetically generated peptide
  VARIANT 10, 11, 16: Xaa = Any Amino Acid
CCEYCCNPAXXCTGCXY

SEQ ID NO: 1551 - protein, 18 aa, Artificial Sequence
  Synthetically generated peptide
  VARIANT 10, 11, 16, 17: Xaa = Any Amino Acid
CCEYCCNPAXXCTGCXXY

SEQ ID NO: 1552 - protein, 16 aa, Artificial Sequence
  Synthetically generated peptide
  VARIANT 10, 12: Xaa = Any Amino Acid
CCEYCCNPAXCXTGCY

SEQ ID NO: 1553 - protein, 17 aa, Artificial Sequence
  Synthetically generated peptide
  VARIANT 10, 12, 13: Xaa = Any Amino Acid
CCEYCCNPAXCXXTGCY

SEQ ID NO: 1554 - protein, 18 aa, Artificial Sequence
  Synthetically generated peptide
  VARIANT 10, 12, 13, 14: Xaa = Any Amino Acid
CCEYCCNPAXCXXXTGCY

SEQ ID NO: 1555 - protein, 18 aa, Artificial Sequence
  Synthetically generated peptide
  VARIANT 10, 12, 13, 15: Xaa = Any Amino Acid
CCEYCCNPAXCXXTXGCY

SEQ ID NO: 1556 - protein, 18 aa, Artificial Sequence
  Synthetically generated peptide
  VARIANT 10, 12, 13, 16: Xaa = Any Amino Acid
CCEYCCNPAXCXXTGXCY

SEQ ID NO: 1557 - protein, 18 aa, Artificial Sequence
  Synthetically generated peptide
  VARIANT 10, 12, 13, 17: Xaa = Any Amino Acid
CCEYCCNPAXCXXTGCXY

SEQ ID NO: 1558 - protein, 17 aa, Artificial Sequence
  Synthetically generated peptide
  VARIANT 10, 12, 14: Xaa = Any Amino Acid
CCEYCCNPAXCXTXGCY

SEQ ID NO: 1559 - protein, 18 aa, Artificial Sequence
  Synthetically generated peptide
  VARIANT 10, 12, 14, 15: Xaa = Any Amino Acid
CCEYCCNPAXCXTXXGCY

SEQ ID NO: 1560 - protein, 18 aa, Artificial Sequence
  Synthetically generated peptide
  VARIANT 10, 12, 14, 16: Xaa = Any Amino Acid
CCEYCCNPAXCXTXGXCY

SEQ ID NO: 1561 - protein, 18 aa, Artificial Sequence
  Synthetically generated peptide
  VARIANT 10, 12, 14, 17: Xaa = Any Amino Acid
CCEYCCNPAXCXTXGCXY

SEQ ID NO: 1562 - protein, 17 aa, Artificial Sequence
  Synthetically generated peptide
  VARIANT 10, 12, 15: Xaa = Any Amino Acid
CCEYCCNPAXCXTGXCY

SEQ ID NO: 1563 - protein, 18 aa, Artificial Sequence
  Synthetically generated peptide
  VARIANT 10, 12, 15, 16: Xaa = Any Amino Acid
CCEYCCNPAXCXTGXXCY

SEQ ID NO: 1564 - protein, 18 aa, Artificial Sequence
  Synthetically generated peptide
  VARIANT 10, 12, 15, 17: Xaa = Any Amino Acid
CCEYCCNPAXCXTGXCXY

SEQ ID NO: 1565 - protein, 17 aa, Artificial Sequence
  Synthetically generated peptide
  VARIANT 10, 12, 16: Xaa = Any Amino Acid
CCEYCCNPAXCXTGCXY

SEQ ID NO: 1566 - protein, 18 aa, Artificial Sequence
  Synthetically generated peptide
  VARIANT 10, 12, 16, 17: Xaa = Any Amino Acid
CCEYCCNPAXCXTGCXXY

SEQ ID NO: 1567 - protein, 16 aa, Artificial Sequence
  Synthetically generated peptide
  VARIANT 10, 13: Xaa = Any Amino Acid
CCEYCCNPAXCTXGCY

SEQ ID NO: 1568 - protein, 17 aa, Artificial Sequence
  Synthetically generated peptide
  VARIANT 10, 13, 14: Xaa = Any Amino Acid
CCEYCCNPAXCTXXGCY

SEQ ID NO: 1569 - protein, 18 aa, Artificial Sequence
  Synthetically generated peptide
  VARIANT 10, 13, 14, 15: Xaa = Any Amino Acid
CCEYCCNPAXCTXXXGCY

SEQ ID NO: 1570 - protein, 18 aa, Artificial Sequence
  Synthetically generated peptide
  VARIANT 10, 13, 14, 16: Xaa = Any Amino Acid
CCEYCCNPAXCTXXGXCY

SEQ ID NO: 1571 - protein, 18 aa, Artificial Sequence
  Synthetically generated peptide
  VARIANT 10, 13, 14, 17: Xaa = Any Amino Acid
CCEYCCNPAXCTXXGCXY

SEQ ID NO: 1572 - protein, 17 aa, Artificial Sequence
  Synthetically generated peptide
  VARIANT 10, 13, 15: Xaa = Any Amino Acid
CCEYCCNPAXCTXGXCY

SEQ ID NO: 1573 - protein, 18 aa, Artificial Sequence
  Synthetically generated peptide
  VARIANT 10, 13, 15, 16: Xaa = Any Amino Acid
CCEYCCNPAXCTXGXXCY

SEQ ID NO: 1574 - protein, 18 aa, Artificial Sequence
  Synthetically generated peptide
  VARIANT 10, 13, 15, 17: Xaa = Any Amino Acid
CCEYCCNPAXCTXGXCXY

SEQ ID NO: 1575 - protein, 17 aa, Artificial Sequence
  Synthetically generated peptide
  VARIANT 10, 13, 16: Xaa = Any Amino Acid
CCEYCCNPAXCTXGCXY

SEQ ID NO: 1576 - protein, 18 aa, Artificial Sequence
  Synthetically generated peptide
  VARIANT 10, 13, 16, 17: Xaa = Any Amino Acid
CCEYCCNPAXCTXGCXXY

SEQ ID NO: 1577 - protein, 16 aa, Artificial Sequence
  Synthetically generated peptide
  VARIANT 10, 14: Xaa = Any Amino Acid
CCEYCCNPAXCTGXCY

SEQ ID NO: 1578 - protein, 17 aa, Artificial Sequence
  Synthetically generated peptide
  VARIANT 10, 14, 15: Xaa = Any Amino Acid
CCEYCCNPAXCTGXXCY

SEQ ID NO: 1579 - protein, 18 aa, Artificial Sequence
  Synthetically generated peptide
  VARIANT 10, 14, 15, 16: Xaa = Any Amino Acid
CCEYCCNPAXCTGXXXCY

SEQ ID NO: 1580 - protein, 18 aa, Artificial Sequence
  Synthetically generated peptide
  VARIANT 10, 14, 15, 17: Xaa = Any Amino Acid
CCEYCCNPAXCTGXXCXY

SEQ ID NO: 1581 - protein, 17 aa, Artificial Sequence
  Synthetically generated peptide
  VARIANT 10, 14, 16: Xaa = Any Amino Acid
CCEYCCNPAXCTGXCXY

SEQ ID NO: 1582 - protein, 18 aa, Artificial Sequence
  Synthetically generated peptide
  VARIANT 10, 14, 16, 17: Xaa = Any Amino Acid
CCEYCCNPAXCTGXCXXY

SEQ ID NO: 1583 - protein, 16 aa, Artificial Sequence
  Synthetically generated peptide
  VARIANT 10, 15: Xaa = Any Amino Acid
CCEYCCNPAXCTGCXY

SEQ ID NO: 1584 - protein, 17 aa, Artificial Sequence
  Synthetically generated peptide
  VARIANT 10, 15, 16: Xaa = Any Amino Acid
CCEYCCNPAXCTGCXXY

SEQ ID NO: 1585 - protein, 18 aa, Artificial Sequence
  Synthetically generated peptide
  VARIANT 10, 15, 16, 17: Xaa = Any Amino Acid
CCEYCCNPAXCTGCXXXY

SEQ ID NO: 1586 - protein, 15 aa, Artificial Sequence
  Synthetically generated peptide
  VARIANT 11: Xaa = Any Amino Acid
CCEYCCNPACXTGCY

SEQ ID NO: 1587 - protein, 16 aa, Artificial Sequence
  Synthetically generated peptide
  VARIANT 11, 12: Xaa = Any Amino Acid
CCEYCCNPACXXTGCY

SEQ ID NO: 1588 - protein, 17 aa, Artificial Sequence
  Synthetically generated peptide
  VARIANT 11, 12, 13: Xaa = Any Amino Acid
CCEYCCNPACXXXTGCY

SEQ ID NO: 1589 - protein, 18 aa, Artificial Sequence
  Synthetically generated peptide
  VARIANT 11, 12, 13, 14: Xaa = Any Amino Acid
CCEYCCNPACXXXXTGCY

SEQ ID NO: 1590 - protein, 18 aa, Artificial Sequence
  Synthetically generated peptide
  VARIANT 11, 12, 13, 15: Xaa = Any Amino Acid
CCEYCCNPACXXXTXGCY

SEQ ID NO: 1591 - protein, 18 aa, Artificial Sequence
  Synthetically generated peptide
  VARIANT 11, 12, 13, 16: Xaa = Any Amino Acid
CCEYCCNPACXXXTGXCY

SEQ ID NO: 1592 - protein, 18 aa, Artificial Sequence
  Synthetically generated peptide
  VARIANT 11, 12, 13, 17: Xaa = Any Amino Acid
CCEYCCNPACXXXTGCXY

SEQ ID NO: 1593 - protein, 17 aa, Artificial Sequence
  Synthetically generated peptide
  VARIANT 11, 12, 14: Xaa = Any Amino Acid
CCEYCCNPACXXTXGCY

SEQ ID NO: 1594 - protein, 18 aa, Artificial Sequence
  Synthetically generated peptide
  VARIANT 11, 12, 14, 15: Xaa = Any Amino Acid
CCEYCCNPACXXTXXGCY

SEQ ID NO: 1595 - protein, 18 aa, Artificial Sequence
  Synthetically generated peptide
  VARIANT 11, 12, 14, 16: Xaa = Any Amino Acid
CCEYCCNPACXXTXGXCY

SEQ ID NO: 1596 - protein, 18 aa, Artificial Sequence
  Synthetically generated peptide
  VARIANT 11, 12, 14, 17: Xaa = Any Amino Acid
CCEYCCNPACXXTXGCXY

SEQ ID NO: 1597 - protein, 17 aa, Artificial Sequence
  Synthetically generated peptide
  VARIANT 11, 12, 15: Xaa = Any Amino Acid
CCEYCCNPACXXTGXCY

SEQ ID NO: 1598 - protein, 18 aa, Artificial Sequence
  Synthetically generated peptide
  VARIANT 11, 12, 15, 16: Xaa = Any Amino Acid
CCEYCCNPACXXTGXXCY

SEQ ID NO: 1599 - protein, 18 aa, Artificial Sequence
  Synthetically generated peptide
  VARIANT 11, 12, 15, 17: Xaa = Any Amino Acid
CCEYCCNPACXXTGXCXY

SEQ ID NO: 1600 - protein, 17 aa, Artificial Sequence
  Synthetically generated peptide
  VARIANT 11, 12, 16: Xaa = Any Amino Acid
CCEYCCNPACXXTGCXY

SEQ ID NO: 1601 - protein, 18 aa, Artificial Sequence
  Synthetically generated peptide
  VARIANT 11, 12, 16, 17: Xaa = Any Amino Acid
CCEYCCNPACXXTGCXXY

SEQ ID NO: 1602 - protein, 16 aa, Artificial Sequence
  Synthetically generated peptide
  VARIANT 11, 13: Xaa = Any Amino Acid
CCEYCCNPACXTXGCY

SEQ ID NO: 1603 - protein, 17 aa, Artificial Sequence
  Synthetically generated peptide
  VARIANT 11, 13, 14: Xaa = Any Amino Acid
CCEYCCNPACXTXXGCY

SEQ ID NO: 1604 - protein, 18 aa, Artificial Sequence
  Synthetically generated peptide
  VARIANT 11, 13, 14, 15: Xaa = Any Amino Acid
CCEYCCNPACXTXXXGCY

SEQ ID NO: 1605 - protein, 18 aa, Artificial Sequence
  Synthetically generated peptide
  VARIANT 11, 13, 14, 16: Xaa = Any Amino Acid
CCEYCCNPACXTXXGXCY

SEQ ID NO: 1606 - protein, 18 aa, Artificial Sequence
  Synthetically generated peptide
  VARIANT 11, 13, 14, 17: Xaa = Any Amino Acid
CCEYCCNPACXTXXGCXY

SEQ ID NO: 1607 - protein, 17 aa, Artificial Sequence
  Synthetically generated peptide
  VARIANT 11, 13, 15: Xaa = Any Amino Acid
CCEYCCNPACXTXGXCY

SEQ ID NO: 1608 - protein, 18 aa, Artificial Sequence
  Synthetically generated peptide
  VARIANT 11, 13, 15, 16: Xaa = Any Amino Acid
CCEYCCNPACXTXGXXCY

SEQ ID NO: 1609 - protein, 18 aa, Artificial Sequence
  Synthetically generated peptide
  VARIANT 11, 13, 15, 17: Xaa = Any Amino Acid
CCEYCCNPACXTXGXCXY

SEQ ID NO: 1610 - protein, 17 aa, Artificial Sequence
  Synthetically generated peptide
  VARIANT 11, 13, 16: Xaa = Any Amino Acid
CCEYCCNPACXTXGCXY

SEQ ID NO: 1611 - protein, 18 aa, Artificial Sequence
  Synthetically generated peptide
  VARIANT 11, 13, 16, 17: Xaa = Any Amino Acid
CCEYCCNPACXTXGCXXY

SEQ ID NO: 1612 - protein, 16 aa, Artificial Sequence
  Synthetically generated peptide
  VARIANT 11, 14: Xaa = Any Amino Acid
CCEYCCNPACXTGXCY

SEQ ID NO: 1613 - protein, 17 aa, Artificial Sequence
  Synthetically generated peptide
  VARIANT 11, 14, 15: Xaa = Any Amino Acid
CCEYCCNPACXTGXXCY

SEQ ID NO: 1614 - protein, 18 aa, Artificial Sequence
  Synthetically generated peptide
  VARIANT 11, 14, 15, 16: Xaa = Any Amino Acid
CCEYCCNPACXTGXXXCY

SEQ ID NO: 1615 - protein, 18 aa, Artificial Sequence
  Synthetically generated peptide
  VARIANT 11, 14, 15, 17: Xaa = Any Amino Acid
CCEYCCNPACXTGXXCXY

SEQ ID NO: 1616 - protein, 17 aa, Artificial Sequence
  Synthetically generated peptide
  VARIANT 11, 14, 16: Xaa = Any Amino Acid
CCEYCCNPACXTGXCXY

SEQ ID NO: 1617 - protein, 18 aa, Artificial Sequence
  Synthetically generated peptide
  VARIANT 11, 14, 16, 17: Xaa = Any Amino Acid
CCEYCCNPACXTGXCXXY

SEQ ID NO: 1618 - protein, 16 aa, Artificial Sequence
  Synthetically generated peptide
  VARIANT 11, 15: Xaa = Any Amino Acid
CCEYCCNPACXTGCXY

SEQ ID NO: 1619 - protein, 17 aa, Artificial Sequence
  Synthetically generated peptide
  VARIANT 11, 15, 16: Xaa = Any Amino Acid
CCEYCCNPACXTGCXXY

SEQ ID NO: 1620 - protein, 18 aa, Artificial Sequence
  Synthetically generated peptide
  VARIANT 11, 15, 16, 17: Xaa = Any Amino Acid
CCEYCCNPACXTGCXXXY

SEQ ID NO: 1621 - protein, 15 aa, Artificial Sequence
  Synthetically generated peptide
  VARIANT 12: Xaa = Any Amino Acid
CCEYCCNPACTXGCY

SEQ ID NO: 1622 - protein, 16 aa, Artificial Sequence
  Synthetically generated peptide
  VARIANT 12, 13: Xaa = Any Amino Acid
CCEYCCNPACTXXGCY

SEQ ID NO: 1623 - protein, 17 aa, Artificial Sequence
  Synthetically generated peptide
  VARIANT 12, 13, 14: Xaa = Any Amino Acid
CCEYCCNPACTXXXGCY

SEQ ID NO: 1624 - protein, 18 aa, Artificial Sequence
  Synthetically generated peptide
  VARIANT 12, 13, 14, 15: Xaa = Any Amino Acid
CCEYCCNPACTXXXXGCY

SEQ ID NO: 1625 - protein, 18 aa, Artificial Sequence
  Synthetically generated peptide
  VARIANT 12, 13, 14, 16: Xaa = Any Amino Acid
CCEYCCNPACTXXXGXCY

SEQ ID NO: 1626 - protein, 18 aa, Artificial Sequence
  Synthetically generated peptide
  VARIANT 12, 13, 14, 17: Xaa = Any Amino Acid
CCEYCCNPACTXXXGCXY

SEQ ID NO: 1627 - protein, 17 aa, Artificial Sequence
  Synthetically generated peptide
  VARIANT 12, 13, 15: Xaa = Any Amino Acid
CCEYCCNPACTXXGXCY

SEQ ID NO: 1628 - protein, 18 aa, Artificial Sequence
  Synthetically generated peptide
  VARIANT 12, 13, 15, 16: Xaa = Any Amino Acid
CCEYCCNPACTXXGXXCY

SEQ ID NO: 1629 - protein, 18 aa, Artificial Sequence
  Synthetically generated peptide
  VARIANT 12, 13, 15, 17: Xaa = Any Amino Acid
CCEYCCNPACTXXGXCXY

SEQ ID NO: 1630 - protein, 17 aa, Artificial Sequence
  Synthetically generated peptide
  VARIANT 12, 13, 16: Xaa = Any Amino Acid
CCEYCCNPACTXXGCXY

SEQ ID NO: 1631 - protein, 18 aa, Artificial Sequence
  Synthetically generated peptide
  VARIANT 12, 13, 16, 17: Xaa = Any Amino Acid
CCEYCCNPACTXXGCXXY

SEQ ID NO: 1632 - protein, 16 aa, Artificial Sequence
  Synthetically generated peptide
  VARIANT 12, 14: Xaa = Any Amino Acid
CCEYCCNPACTXGXCY

SEQ ID NO: 1633 - protein, 17 aa, Artificial Sequence
  Synthetically generated peptide
  VARIANT 12, 14, 15: Xaa = Any Amino Acid
CCEYCCNPACTXGXXCY

SEQ ID NO: 1634 - protein, 18 aa, Artificial Sequence
  Synthetically generated peptide
  VARIANT 12, 14, 15, 16: Xaa = Any Amino Acid
CCEYCCNPACTXGXXXCY

SEQ ID NO: 1635 - protein, 18 aa, Artificial Sequence
  Synthetically generated peptide
  VARIANT 12, 14, 15, 17: Xaa = Any Amino Acid
CCEYCCNPACTXGXXCXY

SEQ ID NO: 1636 - protein, 17 aa, Artificial Sequence
  Synthetically generated peptide
  VARIANT 12, 14, 16: Xaa = Any Amino Acid
CCEYCCNPACTXGXCXY

SEQ ID NO: 1637 - protein, 18 aa, Artificial Sequence
  Synthetically generated peptide
  VARIANT 12, 14, 16, 17: Xaa = Any Amino Acid
CCEYCCNPACTXGXCXXY

SEQ ID NO: 1638 - protein, 16 aa, Artificial Sequence
  Synthetically generated peptide
  VARIANT 12, 15: Xaa = Any Amino Acid
CCEYCCNPACTXGCXY

SEQ ID NO: 1639 - protein, 17 aa, Artificial Sequence
  Synthetically generated peptide
  VARIANT 12, 15, 16: Xaa = Any Amino Acid
CCEYCCNPACTXGCXXY

SEQ ID NO: 1640 - protein, 18 aa, Artificial Sequence
  Synthetically generated peptide
  VARIANT 12, 15, 16, 17: Xaa = Any Amino Acid
CCEYCCNPACTXGCXXXY

SEQ ID NO: 1641 - protein, 15 aa, Artificial Sequence
  Synthetically generated peptide
  VARIANT 13: Xaa = Any Amino Acid
CCEYCCNPACTGXCY

SEQ ID NO: 1642 - protein, 16 aa, Artificial Sequence
  Synthetically generated peptide
  VARIANT 13, 14: Xaa = Any Amino Acid
CCEYCCNPACTGXXCY

SEQ ID NO: 1643 - protein, 17 aa, Artificial Sequence
  Synthetically generated peptide
  VARIANT 13, 14, 15: Xaa = Any Amino Acid
CCEYCCNPACTGXXXCY

SEQ ID NO: 1644 - protein, 18 aa, Artificial Sequence
  Synthetically generated peptide
  VARIANT 13, 14, 15, 16: Xaa = Any Amino Acid
CCEYCCNPACTGXXXXCY

SEQ ID NO: 1645 - protein, 18 aa, Artificial Sequence
  Synthetically generated peptide
  VARIANT 13, 14, 15, 17: Xaa = Any Amino Acid
CCEYCCNPACTGXXXCXY

SEQ ID NO: 1646 - protein, 17 aa, Artificial Sequence
  Synthetically generated peptide
  VARIANT 13, 14, 16: Xaa = Any Amino Acid
CCEYCCNPACTGXXCXY

SEQ ID NO: 1647 - protein, 18 aa, Artificial Sequence
  Synthetically generated peptide
  VARIANT 13, 14, 16, 17: Xaa = Any Amino Acid
CCEYCCNPACTGXXCXXY

SEQ ID NO: 1648 - protein, 16 aa, Artificial Sequence
  Synthetically generated peptide
  VARIANT 13, 15: Xaa = Any Amino Acid
CCEYCCNPACTGXCXY

SEQ ID NO: 1649 - protein, 17 aa, Artificial Sequence
  Synthetically generated peptide
  VARIANT 13, 15, 16: Xaa = Any Amino Acid
CCEYCCNPACTGXCXXY

SEQ ID NO: 1650 - protein, 18 aa, Artificial Sequence
  Synthetically generated peptide
  VARIANT 13, 15, 16, 17: Xaa = Any Amino Acid
CCEYCCNPACTGXCXXXY

SEQ ID NO: 1651 - protein, 15 aa, Artificial Sequence
  Synthetically generated peptide
  VARIANT 14: Xaa = Any Amino Acid
CCEYCCNPACTGCXY

SEQ ID NO: 1652 - protein, 16 aa, Artificial Sequence
  Synthetically generated peptide
  VARIANT 14, 15: Xaa = Any Amino Acid
CCEYCCNPACTGCXXY

SEQ ID NO: 1653 - protein, 17 aa, Artificial Sequence
  Synthetically generated peptide
  VARIANT 14, 15, 16: Xaa = Any Amino Acid
CCEYCCNPACTGCXXXY

SEQ ID NO: 1654 - protein, 18 aa, Artificial Sequence
  Synthetically generated peptide
  VARIANT 14, 15, 16, 17: Xaa = Any Amino Acid
CCEYCCNPACTGCXXXXY

SEQ ID NO: 1655 - DNA, 42 bp, Artificial Sequence
  Synthetically generated oligonucleotide
cacaccatatgaagaaatcaatattatttatttttctttctg

SEQ ID NO: 1656 - DNA, 46 bp, Artificial Sequence
  Synthetically generated oligonucleotide
cacacctcgagttaggtctccatgctttcaggaccacttttattac

SEQ ID NO: 1657 - DNA, 69 bp, Artificial Sequence
  Synthetically generated oligonucleotide
gcatgaatagtagcaattactgctgtgaattgtgttgtaatcctgcttgtaccgggtgctattaataac

SEQ ID NO: 1658 - DNA, 69 bp, Artificial Sequence
  Synthetically generated oligonucleotide
tcgagttattaatagcacccggtacaagcaggattacaacacaattcacagcagtaattgctactattc

SEQ ID NO: 1659 - DNA, 69 bp, Artificial Sequence
  Synthetically generated oligonucleotide
gcatgaatagtagcaattactgctgtgaatattgttgtaatcctgcttgtaccgggtgctattaataac

SEQ ID NO: 1660 - DNA, 69 bp, Artificial Sequence
  Synthetically generated oligonucleotide
tcgagttattaatagcacccggtacaagcaggattacaacaatattcacagcagtaattgctactattc

SEQ ID NO: 1661 - protein, 5 aa, Artificial Sequence
  Synthetically generated peptide
QHNPR

SEQ ID NO: 1662 - protein, 6 aa, Artificial Sequence
  Synthetically generated peptide
VQHNPR

SEQ ID NO: 1663 - protein, 7 aa, Artificial Sequence
  Synthetically generated peptide
VRQHNPR

SEQ ID NO: 1664 - protein, 8 aa, Artificial Sequence
  Synthetically generated peptide
VRGQHNPR

SEQ ID NO: 1665 - protein, 9 aa, Artificial Sequence
  Synthetically generated peptide
VRGPQHNPR

SEQ ID NO: 1666 - protein, 10 aa, Artificial Sequence
  Synthetically generated peptide
VRGPRQHNPR

SEQ ID NO: 1667 - protein, 11 aa, Artificial Sequence
  Synthetically generated peptide
VRGPRRQHNPR

SEQ ID NO: 1668 - protein, 6 aa, Artificial Sequence
  Synthetically generated peptide
RQHNPR

SEQ ID NO: 1669 - protein, 14 aa, Artificial Sequence
  Synthetically generated peptide
CCELCCAPACTGCY

SEQ ID NO: 1670 - protein, 14 aa, Artificial Sequence
  Synthetically generated peptide
CCELCCVPACTGCY

SEQ ID NO: 1671 - protein, 14 aa, Artificial Sequence
  Synthetically generated peptide
CCELCCLPACTGCY

SEQ ID NO: 1672 - protein, 14 aa, Artificial Sequence
  Synthetically generated peptide
CCELCCIPACTGCY

SEQ ID NO: 1673 - protein, 14 aa, Artificial Sequence
  Synthetically generated peptide
CCELCCPPACTGCY

SEQ ID NO: 1674 - protein, 14 aa, Artificial Sequence
  Synthetically generated peptide
CCELCCMPACTGCY

SEQ ID NO: 1675 - protein, 14 aa, Artificial Sequence
  Synthetically generated peptide
CCELCCFPACTGCY

SEQ ID NO: 1676 - protein, 14 aa, Artificial Sequence
  Synthetically generated peptide
CCELCCWPACTGCY

SEQ ID NO: 1677 - protein, 14 aa, Artificial Sequence
  Synthetically generated peptide
CCELCCGPACTGCY

SEQ ID NO: 1678 - protein, 14 aa, Artificial Sequence
  Synthetically generated peptide
CCELCCSPACTGCY

SEQ ID NO: 1679 - protein, 14 aa, Artificial Sequence
  Synthetically generated peptide
CCELCCTPACTGCY

SEQ ID NO: 1680 - protein, 14 aa, Artificial Sequence
  Synthetically generated peptide
CCELCCCPACTGCY

SEQ ID NO: 1681 - protein, 14 aa, Artificial Sequence
  Synthetically generated peptide
CCELCCQPACTGCY

SEQ ID NO: 1682 - protein, 14 aa, Artificial Sequence
  Synthetically generated peptide
CCELCCYPACTGCY

SEQ ID NO: 1683 - protein, 14 aa, Artificial Sequence
  Synthetically generated peptide
CCELCCDPACTGCY

SEQ ID NO: 1684 - protein, 14 aa, Artificial Sequence
  Synthetically generated peptide
CCELCCEPACTGCY

SEQ ID NO: 1685 - protein, 14 aa, Artificial Sequence
  Synthetically generated peptide
CCELCCKPACTGCY

SEQ ID NO: 1686 - protein, 14 aa, Artificial Sequence
  Synthetically generated peptide
CCELCCRPACTGCY

SEQ ID NO: 1687 - protein, 14 aa, Artificial Sequence
  Synthetically generated peptide
CCELCCHPACTGCY

SEQ ID NO: 1688 - protein, 14 aa, Artificial Sequence
  Synthetically generated peptide
CCEYCCAPACTGCY

SEQ ID NO: 1689 - protein, 14 aa, Artificial Sequence
  Synthetically generated peptide
CCEYCCVPACTGCY

SEQ ID NO: 1690 - protein, 14 aa, Artificial Sequence
  Synthetically generated peptide
CCEYCCLPACTGCY

SEQ ID NO: 1691 - protein, 14 aa, Artificial Sequence
  Synthetically generated peptide
CCEYCCIPACTGCY

SEQ ID NO: 1692 - protein, 14 aa, Artificial Sequence
  Synthetically generated peptide
CCEYCCPPACTGCY

SEQ ID NO: 1693 - protein, 14 aa, Artificial Sequence
  Synthetically generated peptide
CCEYCCMPACTGCY

SEQ ID NO: 1694 - protein, 14 aa, Artificial Sequence
  Synthetically generated peptide
CCEYCCFPACTGCY

SEQ ID NO: 1695 - protein, 14 aa, Artificial Sequence
  Synthetically generated peptide
CCEYCCWPACTGCY

SEQ ID NO: 1696 - protein, 14 aa, Artificial Sequence
  Synthetically generated peptide
CCEYCCGPACTGCY

SEQ ID NO: 1697 - protein, 14 aa, Artificial Sequence
  Synthetically generated peptide
CCEYCCSPACTGCY

SEQ ID NO: 1698 - protein, 14 aa, Artificial Sequence
  Synthetically generated peptide
CCEYCCTPACTGCY

SEQ ID NO: 1699 - protein, 14 aa, Artificial Sequence
  Synthetically generated peptide
CCEYCCCPACTGCY

SEQ ID NO: 1700 - protein, 14 aa, Artificial Sequence
  Synthetically generated peptide
CCEYCCQPACTGCY

SEQ ID NO: 1701 - protein, 14 aa, Artificial Sequence
  Synthetically generated peptide
CCEYCCYPACTGCY

SEQ ID NO: 1702 - protein, 14 aa, Artificial Sequence
  Synthetically generated peptide
CCEYCCDPACTGCY

SEQ ID NO: 1703 - protein, 14 aa, Artificial Sequence
  Synthetically generated peptide
CCEYCCEPACTGCY

SEQ ID NO: 1704 - protein, 14 aa, Artificial Sequence
  Synthetically generated peptide
CCEYCCKPACTGCY

SEQ ID NO: 1705 - protein, 14 aa, Artificial Sequence
  Synthetically generated peptide
CCEYCCRPACTGCY

SEQ ID NO: 1706 - protein, 14 aa, Artificial Sequence
  Synthetically generated peptide
CCEYCCHPACTGCY

SEQ ID NO: 1707 - protein, 13 aa, Artificial Sequence
  Synthetically generated peptide
CCELCCAPACTGC

SEQ ID NO: 1708 - protein, 13 aa, Artificial Sequence
  Synthetically generated peptide
CCELCCVPACTGC

SEQ ID NO: 1709 - protein, 13 aa, Artificial Sequence
  Synthetically generated peptide
CCELCCLPACTGC

SEQ ID NO: 1710 - protein, 13 aa, Artificial Sequence
  Synthetically generated peptide
CCELCCIPACTGC

SEQ ID NO: 1711 - protein, 13 aa, Artificial Sequence
  Synthetically generated peptide
CCELCCPPACTGC

SEQ ID NO: 1712 - protein, 13 aa, Artificial Sequence
  Synthetically generated peptide
CCELCCMPACTGC

SEQ ID NO: 1713 - protein, 13 aa, Artificial Sequence
  Synthetically generated peptide
CCELCCFPACTGC

SEQ ID NO: 1714 - protein, 13 aa, Artificial Sequence
  Synthetically generated peptide
CCELCCWPACTGC

SEQ ID NO: 1715 - protein, 13 aa, Artificial Sequence
  Synthetically generated peptide
CCELCCGPACTGC

SEQ ID NO: 1716 - protein, 13 aa, Artificial Sequence
  Synthetically generated peptide
CCELCCSPACTGC

SEQ ID NO: 1717 - protein, 13 aa, Artificial Sequence
  Synthetically generated peptide
CCELCCTPACTGC

SEQ ID NO: 1718 - protein, 13 aa, Artificial Sequence
  Synthetically generated peptide
CCELCCCPACTGC

SEQ ID NO: 1719 - protein, 13 aa, Artificial Sequence
  Synthetically generated peptide
CCELCCQPACTGC

SEQ ID NO: 1720 - protein, 13 aa, Artificial Sequence
  Synthetically generated peptide
CCELCCYPACTGC

SEQ ID NO: 1721 - protein, 13 aa, Artificial Sequence
  Synthetically generated peptide
CCELCCDPACTGC

SEQ ID NO: 1722 - protein, 13 aa, Artificial Sequence
  Synthetically generated peptide
CCELCCEPACTGC

SEQ ID NO: 1723 - protein, 13 aa, Artificial Sequence
  Synthetically generated peptide
CCELCCKPACTGC

SEQ ID NO: 1724 - protein, 13 aa, Artificial Sequence
  Synthetically generated peptide
CCELCCRPACTGC

SEQ ID NO: 1725 - protein, 13 aa, Artificial Sequence
  Synthetically generated peptide
CCELCCHPACTGC

SEQ ID NO: 1726 - protein, 13 aa, Artificial Sequence
  Synthetically generated peptide
CCEYCCAPACTGC

SEQ ID NO: 1727 - protein, 13 aa, Artificial Sequence
  Synthetically generated peptide
CCEYCCVPACTGC

SEQ ID NO: 1728 - protein, 13 aa, Artificial Sequence
  Synthetically generated peptide
CCEYCCLPACTGC

SEQ ID NO: 1729 - protein, 13 aa, Artificial Sequence
  Synthetically generated peptide
CCEYCCIPACTGC

SEQ ID NO: 1730 - protein, 13 aa, Artificial Sequence
  Synthetically generated peptide
CCEYCCPPACTGC

SEQ ID NO: 1731 - protein, 13 aa, Artificial Sequence
  Synthetically generated peptide
CCEYCCMPACTGC

SEQ ID NO: 1732 - protein, 13 aa, Artificial Sequence
  Synthetically generated peptide
CCEYCCFPACTGC

SEQ ID NO: 1733 - protein, 13 aa, Artificial Sequence
  Synthetically generated peptide
CCEYCCWPACTGC

SEQ ID NO: 1734 - protein, 13 aa, Artificial Sequence
  Synthetically generated peptide
CCEYCCGPACTGC

SEQ ID NO: 1735 - protein, 13 aa, Artificial Sequence
  Synthetically generated peptide
CCEYCCSPACTGC

SEQ ID NO: 1736 - protein, 13 aa, Artificial Sequence
  Synthetically generated peptide
CCEYCCTPACTGC

SEQ ID NO: 1737 - protein, 13 aa, Artificial Sequence
  Synthetically generated peptide
CCEYCCCPACTGC

SEQ ID NO: 1738 - protein, 13 aa, Artificial Sequence
  Synthetically generated peptide
CCEYCCQPACTGC

SEQ ID NO: 1739 - protein, 13 aa, Artificial Sequence
  Synthetically generated peptide
CCEYCCYPACTGC

SEQ ID NO: 1740 - protein, 13 aa, Artificial Sequence
  Synthetically generated peptide
CCEYCCDPACTGC

SEQ ID NO: 1741 - protein, 13 aa, Artificial Sequence
  Synthetically generated peptide
CCEYCCEPACTGC

SEQ ID NO: 1742 - protein, 13 aa, Artificial Sequence
  Synthetically generated peptide
CCEYCCKPACTGC

SEQ ID NO: 1743 - protein, 13 aa, Artificial Sequence
  Synthetically generated peptide
CCEYCCRPACTGC

SEQ ID NO: 1744 - protein, 13 aa, Artificial Sequence
  Synthetically generated peptide
CCEYCCHPACTGC

SEQ ID NO: 1745 - protein, 14 aa, Artificial Sequence
  Synthetically generated peptide
CCELCCNPTCTGCY

SEQ ID NO: 1746 - protein, 14 aa, Artificial Sequence
  Synthetically generated peptide
CCEYCCNPTCTGCY

SEQ ID NO: 1747 - protein, 13 aa, Artificial Sequence
  Synthetically generated peptide
CCELCCNPTCTGC

SEQ ID NO: 1748 - protein, 13 aa, Artificial Sequence
  Synthetically generated peptide
CCEYCCNPTCTGC

SEQ ID NO: 1749 - protein, 14 aa, Artificial Sequence
  Synthetically generated peptide
CCEFCCNPTCTGCY

SEQ ID NO: 1750 - protein, 13 aa, Artificial Sequence
  Synthetically generated peptide
CCEFCCNPTCTGC

SEQ ID NO: 1751 - protein, 14 aa, Artificial Sequence
  Synthetically generated peptide
CCEWCCNPTCTGCY

SEQ ID NO: 1752 - protein, 13 aa, Artificial Sequence
  Synthetically generated peptide
CCEWCCNPTCTGC

SEQ ID NO: 1753 - protein, 14 aa, Artificial Sequence
  Synthetically generated peptide
CCELCCNGACTGCY

SEQ ID NO: 1754 - protein, 14 aa, Artificial Sequence
  Synthetically generated peptide
CCEYCCNGACTGCY

SEQ ID NO: 1755 - protein, 13 aa, Artificial Sequence
  Synthetically generated peptide
CCELCCNGACTGC

SEQ ID NO: 1756 - protein, 13 aa, Artificial Sequence
  Synthetically generated peptide
CCEYCCNGACTGC

SEQ ID NO: 1757 - protein, 14 aa, Artificial Sequence
  Synthetically generated peptide
CCEFCCNGACTGCY

SEQ ID NO: 1758 - protein, 13 aa, Artificial Sequence
  Synthetically generated peptide
CCEFCCNGACTGC

SEQ ID NO: 1759 - protein, 14 aa, Artificial Sequence
  Synthetically generated peptide
CCEWCCNGACTGCY

SEQ ID NO: 1760 - protein, 13 aa, Artificial Sequence
  Synthetically generated peptide
CCEWCCNGACTGC

SEQ ID NO: 1761 - protein, 14 aa, Artificial Sequence
  Synthetically generated peptide
CCELCCNPACVGCY

SEQ ID NO: 1762 - protein, 14 aa, Artificial Sequence
  Synthetically generated peptide
CCEYCCNPACVGCY

SEQ ID NO: 1763 - protein, 13 aa, Artificial Sequence
  Synthetically generated peptide
CCELCCNPACVGC

SEQ ID NO: 1764 - protein, 13 aa, Artificial Sequence
  Synthetically generated peptide
CCEYCCNPACVGC

SEQ ID NO: 1765 - protein, 14 aa, Artificial Sequence
  Synthetically generated peptide
CCEFCCNPACVGCY

SEQ ID NO: 1766 - protein, 13 aa, Artificial Sequence
  Synthetically generated peptide
CCEFCCNPACVGC

SEQ ID NO: 1767 - protein, 14 aa, Artificial Sequence
  Synthetically generated peptide
CCEWCCNPACVGCY

SEQ ID NO: 1768 - protein, 13 aa, Artificial Sequence
  Synthetically generated peptide
CCEWCCNPACVGC

SEQ ID NO: 1769 - protein, 14 aa, Artificial Sequence
  Synthetically generated peptide
CCELCCNPACGGCY

SEQ ID NO: 1770 - protein, 14 aa, Artificial Sequence
  Synthetically generated peptide
CCEYCCNPACGGCY

SEQ ID NO: 1771 - protein, 13 aa, Artificial Sequence
  Synthetically generated peptide
CCELCCNPACGGC

SEQ ID NO: 1772 - protein, 13 aa, Artificial Sequence
  Synthetically generated peptide
CCEYCCNPACGGC

SEQ ID NO: 1773 - protein, 14 aa, Artificial Sequence
  Synthetically generated peptide
CCEFCCNPACGGCY

SEQ ID NO: 1774 - protein, 13 aa, Artificial Sequence
  Synthetically generated peptide
CCEFCCNPACGGC

SEQ ID NO: 1775 - protein, 14 aa, Artificial Sequence
  Synthetically generated peptide
CCEWCCNPACGGCY

SEQ ID NO: 1776 - protein, 13 aa, Artificial Sequence
  Synthetically generated peptide
CCEWCCNPACGGC

SEQ ID NO: 1777 - protein, 14 aa, Artificial Sequence
  Synthetically generated peptide
CCELCCNPACTACY

SEQ ID NO: 1778 - protein, 14 aa, Artificial Sequence
  Synthetically generated peptide
CCEYCCNPACTACY

SEQ ID NO: 1779 - protein, 13 aa, Artificial Sequence
  Synthetically generated peptide
CCELCCNPACTAC

SEQ ID NO: 1780 - protein, 13 aa, Artificial Sequence
  Synthetically generated peptide
CCEYCCNPACTAC

SEQ ID NO: 1781 - protein, 14 aa, Artificial Sequence
  Synthetically generated peptide
CCEWCCNPACTACY

SEQ ID NO: 1782 - protein, 13 aa, Artificial Sequence
  Synthetically generated peptide
CCEWCCNPACTAC

SEQ ID NO: 1783 - protein, 14 aa, Artificial Sequence
  Synthetically generated peptide
CCEFCCNPACTACY

SEQ ID NO: 1784 - protein, 13 aa, Artificial Sequence
  Synthetically generated peptide
CCEFCCNPACTAC

SEQ ID NO: 1785 - protein, 14 aa, Artificial Sequence
  Synthetically generated peptide
CCELCCNPACTGCA

SEQ ID NO: 1786 - protein, 14 aa, Artificial Sequence
  Synthetically generated peptide
CCELCCNPACTGCV

SEQ ID NO: 1787 - protein, 14 aa, Artificial Sequence
  Synthetically generated peptide
CCELCCNPACTGCL

SEQ ID NO: 1788 - protein, 14 aa, Artificial Sequence
  Synthetically generated peptide
CCELCCNPACTGCI

SEQ ID NO: 1789 - protein, 14 aa, Artificial Sequence
  Synthetically generated peptide
CCELCCNPACTGCP

SEQ ID NO: 1790 - protein, 14 aa, Artificial Sequence
  Synthetically generated peptide
CCELCCNPACTGCM

SEQ ID NO: 1791 - protein, 14 aa, Artificial Sequence
  Synthetically generated peptide
CCELCCNPACTGCF

SEQ ID NO: 1792 - protein, 14 aa, Artificial Sequence
  Synthetically generated peptide
CCELCCNPACTGCW

SEQ ID NO: 1793 - protein, 14 aa, Artificial Sequence
  Synthetically generated peptide
CCELCCNPACTGCG

SEQ ID NO: 1794 - protein, 14 aa, Artificial Sequence
  Synthetically generated peptide
CCELCCNPACTGCS

SEQ ID NO: 1795 - protein, 14 aa, Artificial Sequence
  Synthetically generated peptide
CCELCCNPACTGCT

SEQ ID NO: 1796 - protein, 14 aa, Artificial Sequence
  Synthetically generated peptide
CCELCCNPACTGCC

SEQ ID NO: 1797 - protein, 14 aa, Artificial Sequence
  Synthetically generated peptide
CCELCCNPACTGCN

SEQ ID NO: 1798 - protein, 14 aa, Artificial Sequence
  Synthetically generated peptide
CCELCCNPACTGCQ

SEQ ID NO: 1799 - protein, 14 aa, Artificial Sequence
  Synthetically generated peptide
CCELCCNPACTGCD

SEQ ID NO: 1800 - protein, 14 aa, Artificial Sequence
  Synthetically generated peptide
CCELCCNPACTGCE

SEQ ID NO: 1801 - protein, 14 aa, Artificial Sequence
  Synthetically generated peptide
CCELCCNPACTGCK

SEQ ID NO: 1802 - protein, 14 aa, Artificial Sequence
  Synthetically generated peptide
CCELCCNPACTGCR

SEQ ID NO: 1803 - protein, 14 aa, Artificial Sequence
  Synthetically generated peptide
CCELCCNPACTGCH

SEQ ID NO: 1804 - protein, 14 aa, Artificial Sequence
  Synthetically generated peptide
CCEYCCNPACTGCA

SEQ ID NO: 1805 - protein, 14 aa, Artificial Sequence
  Synthetically generated peptide
CCEYCCNPACTGCV

SEQ ID NO: 1806 - protein, 14 aa, Artificial Sequence
  Synthetically generated peptide
CCEYCCNPACTGCL

SEQ ID NO: 1807 - protein, 14 aa, Artificial Sequence
  Synthetically generated peptide
CCEYCCNPACTGCI

SEQ ID NO: 1808 - protein, 14 aa, Artificial Sequence
  Synthetically generated peptide
CCEYCCNPACTGCP

SEQ ID NO: 1809 - protein, 14 aa, Artificial Sequence
  Synthetically generated peptide
CCEYCCNPACTGCM

SEQ ID NO: 1810 - protein, 14 aa, Artificial Sequence
  Synthetically generated peptide
CCEYCCNPACTGCF

SEQ ID NO: 1811 - protein, 14 aa, Artificial Sequence
  Synthetically generated peptide
CCEYCCNPACTGCW

SEQ ID NO: 1812 - protein, 14 aa, Artificial Sequence
  Synthetically generated peptide
CCEYCCNPACTGCG

SEQ ID NO: 1813 - protein, 14 aa, Artificial Sequence
  Synthetically generated peptide
CCEYCCNPACTGCS

SEQ ID NO: 1814 - protein, 14 aa, Artificial Sequence
  Synthetically generated peptide
CCEYCCNPACTGCT

SEQ ID NO: 1815 - protein, 14 aa, Artificial Sequence
  Synthetically generated peptide
CCEYCCNPACTGCC

SEQ ID NO: 1816 - protein, 14 aa, Artificial Sequence
  Synthetically generated peptide
CCEYCCNPACTGCN

SEQ ID NO: 1817 - protein, 14 aa, Artificial Sequence
  Synthetically generated peptide
CCEYCCNPACTGCQ

SEQ ID NO: 1818 - protein, 14 aa, Artificial Sequence
  Synthetically generated peptide
CCEYCCNPACTGCD

SEQ ID NO: 1819 - protein, 14 aa, Artificial Sequence
  Synthetically generated peptide
CCEYCCNPACTGCE

SEQ ID NO: 1820 - protein, 14 aa, Artificial Sequence
  Synthetically generated peptide
CCEYCCNPACTGCK

SEQ ID NO: 1821 - protein, 14 aa, Artificial Sequence
  Synthetically generated peptide
CCEYCCNPACTGCR

SEQ ID NO: 1822 - protein, 14 aa, Artificial Sequence
  Synthetically generated peptide
CCEYCCNPACTGCH

SEQ ID NO: 1823 - protein, 14 aa, Artificial Sequence
  Synthetically generated peptide
CCALCCNPACTGCY

SEQ ID NO: 1824 - protein, 14 aa, Artificial Sequence
  Synthetically generated peptide
CCVLCCNPACTGCY

SEQ ID NO: 1825 - protein, 14 aa, Artificial Sequence
  Synthetically generated peptide
CCLLCCNPACTGCY

SEQ ID NO: 1826 - protein, 14 aa, Artificial Sequence
  Synthetically generated peptide
CCILCCNPACTGCY

SEQ ID NO: 1827 - protein, 14 aa, Artificial Sequence
  Synthetically generated peptide
CCMLCCNPACTGCY

SEQ ID NO: 1828 - protein, 14 aa, Artificial Sequence
  Synthetically generated peptide
CCFLCCNPACTGCY

SEQ ID NO: 1829 - protein, 14 aa, Artificial Sequence
  Synthetically generated peptide
CCWLCCNPACTGCY

SEQ ID NO: 1830 - protein, 14 aa, Artificial Sequence
  Synthetically generated peptide
CCGLCCNPACTGCY

SEQ ID NO: 1831 - protein, 14 aa, Artificial Sequence
  Synthetically generated peptide
CCSLCCNPACTGCY

SEQ ID NO: 1832 - protein, 14 aa, Artificial Sequence
  Synthetically generated peptide
CCTLCCNPACTGCY

SEQ ID NO: 1833 - protein, 14 aa, Artificial Sequence
  Synthetically generated peptide
CCCLCCNPACTGCY

SEQ ID NO: 1834 - protein, 14 aa, Artificial Sequence
  Synthetically generated peptide
CCNLCCNPACTGCY

SEQ ID NO: 1835 - protein, 14 aa, Artificial Sequence
  Synthetically generated peptide
CCQLCCNPACTGCY

SEQ ID NO: 1836 - protein, 14 aa, Artificial Sequence
  Synthetically generated peptide
CCYLCCNPACTGCY

SEQ ID NO: 1837 - protein, 14 aa, Artificial Sequence
  Synthetically generated peptide
CCDLCCNPACTGCY

SEQ ID NO: 1838 - protein, 14 aa, Artificial Sequence
  Synthetically generated peptide
CCKLCCNPACTGCY

SEQ ID NO: 1839 - protein, 14 aa, Artificial Sequence
  Synthetically generated peptide
CCRLCCNPACTGCY

SEQ ID NO: 1840 - protein, 14 aa, Artificial Sequence
  Synthetically generated peptide
CCHLCCNPACTGCY

SEQ ID NO: 1841 - protein, 13 aa, Artificial Sequence
  Synthetically generated peptide
CCALCCNPACTGC

SEQ ID NO: 1842 - protein, 13 aa, Artificial Sequence
  Synthetically generated peptide
CCVLCCNPACTGC

SEQ ID NO: 1843 - protein, 13 aa, Artificial Sequence
  Synthetically generated peptide
CCLLCCNPACTGC

SEQ ID NO: 1844 - protein, 13 aa, Artificial Sequence
  Synthetically generated peptide
CCILCCNPACTGC

SEQ ID NO: 1845 - protein, 13 aa, Artificial Sequence
  Synthetically generated peptide
CCMLCCNPACTGC

SEQ ID NO: 1846 - protein, 13 aa, Artificial Sequence
  Synthetically generated peptide
CCFLCCNPACTGC

SEQ ID NO: 1847 - protein, 13 aa, Artificial Sequence
  Synthetically generated peptide
CCWLCCNPACTGC

SEQ ID NO: 1848 - protein, 13 aa, Artificial Sequence
  Synthetically generated peptide
CCGLCCNPACTGC

SEQ ID NO: 1849 - protein, 13 aa, Artificial Sequence
  Synthetically generated peptide
CCSLCCNPACTGC

SEQ ID NO: 1850 - protein, 13 aa, Artificial Sequence
  Synthetically generated peptide
CCTLCCNPACTGC

SEQ ID NO: 1851 - protein, 13 aa, Artificial Sequence
  Synthetically generated peptide
CCCLCCNPACTGC

SEQ ID NO: 1852 - protein, 13 aa, Artificial Sequence
  Synthetically generated peptide
CCNLCCNPACTGC

SEQ ID NO: 1853 - protein, 13 aa, Artificial Sequence
  Synthetically generated peptide
CCQLCCNPACTGC

SEQ ID NO: 1854 - protein, 13 aa, Artificial Sequence
  Synthetically generated peptide
CCYLCCNPACTGC

SEQ ID NO: 1855 - protein, 13 aa, Artificial Sequence
  Synthetically generated peptide
CCDLCCNPACTGC

SEQ ID NO: 1856 - protein, 13 aa, Artificial Sequence
  Synthetically generated peptide
CCKLCCNPACTGC

SEQ ID NO: 1857 - protein, 13 aa, Artificial Sequence
  Synthetically generated peptide
CCRLCCNPACTGC

SEQ ID NO: 1858 - protein, 13 aa, Artificial Sequence
  Synthetically generated peptide
CCHLCCNPACTGC

SEQ ID NO: 1859 - protein, 14 aa, Artificial Sequence
  Synthetically generated peptide
CCAYCCNPACTGCY

SEQ ID NO: 1860 - protein, 14 aa, Artificial Sequence
  Synthetically generated peptide
CCVYCCNPACTGCY

SEQ ID NO: 1861 - protein, 14 aa, Artificial Sequence
  Synthetically generated peptide
CCLYCCNPACTGCY

SEQ ID NO: 1862 - protein, 14 aa, Artificial Sequence
  Synthetically generated peptide
CCIYCCNPACTGCY

SEQ ID NO: 1863 - protein, 14 aa, Artificial Sequence
  Synthetically generated peptide
CCMYCCNPACTGCY

SEQ ID NO: 1864 - protein, 14 aa, Artificial Sequence
  Synthetically generated peptide
CCFYCCNPACTGCY

SEQ ID NO: 1865 - protein, 14 aa, Artificial Sequence
  Synthetically generated peptide
CCWYCCNPACTGCY

SEQ ID NO: 1866 - protein, 14 aa, Artificial Sequence
  Synthetically generated peptide
CCGYCCNPACTGCY

SEQ ID NO: 1867 - protein, 14 aa, Artificial Sequence
  Synthetically generated peptide
CCSYCCNPACTGCY

SEQ ID NO: 1868 - protein, 14 aa, Artificial Sequence
  Synthetically generated peptide
CCTYCCNPACTGCY

SEQ ID NO: 1869 - protein, 14 aa, Artificial Sequence
  Synthetically generated peptide
CCCYCCNPACTGCY

SEQ ID NO: 1870 - protein, 14 aa, Artificial Sequence
  Synthetically generated peptide
CCNYCCNPACTGCY

SEQ ID NO: 1871 - protein, 14 aa, Artificial Sequence
  Synthetically generated peptide
CCQYCCNPACTGCY

SEQ ID NO: 1872 - protein, 14 aa, Artificial Sequence
  Synthetically generated peptide
CCYYCCNPACTGCY

SEQ ID NO: 1873 - protein, 14 aa, Artificial Sequence
  Synthetically generated peptide
CCDYCCNPACTGCY

SEQ ID NO: 1874 - protein, 14 aa, Artificial Sequence
  Synthetically generated peptide
CCKYCCNPACTGCY

SEQ ID NO: 1875 - protein, 14 aa, Artificial Sequence
  Synthetically generated peptide
CCRYCCNPACTGCY

SEQ ID NO: 1876 - protein, 14 aa, Artificial Sequence
  Synthetically generated peptide
CCHYCCNPACTGCY

SEQ ID NO: 1877 - protein, 13 aa, Artificial Sequence
  Synthetically generated peptide
CCAYCCNPACTGC

SEQ ID NO: 1878 - protein, 13 aa, Artificial Sequence
  Synthetically generated peptide
CCVYCCNPACTGC

SEQ ID NO: 1879 - protein, 13 aa, Artificial Sequence
  Synthetically generated peptide
CCLYCCNPACTGC

SEQ ID NO: 1880 - protein, 13 aa, Artificial Sequence
  Synthetically generated peptide
CCIYCCNPACTGC

SEQ ID NO: 1881 - protein, 13 aa, Artificial Sequence
  Synthetically generated peptide
CCMYCCNPACTGC

SEQ ID NO: 1882 - protein, 13 aa, Artificial Sequence
  Synthetically generated peptide
CCFYCCNPACTGC

SEQ ID NO: 1883 - protein, 13 aa, Artificial Sequence
  Synthetically generated peptide
CCWYCCNPACTGC

SEQ ID NO: 1884 - protein, 13 aa, Artificial Sequence
  Synthetically generated peptide
CCGYCCNPACTGC

SEQ ID NO: 1885 - protein, 13 aa, Artificial Sequence
  Synthetically generated peptide
CCSYCCNPACTGC

SEQ ID NO: 1886 - protein, 13 aa, Artificial Sequence
  Synthetically generated peptide
CCTYCCNPACTGC

SEQ ID NO: 1887 - protein, 13 aa, Artificial Sequence
  Synthetically generated peptide
CCCYCCNPACTGC

SEQ ID NO: 1888 - protein, 13 aa, Artificial Sequence
  Synthetically generated peptide
CCNYCCNPACTGC

SEQ ID NO: 1889 - protein, 13 aa, Artificial Sequence
  Synthetically generated peptide
CCQYCCNPACTGC

SEQ ID NO: 1890 - protein, 13 aa, Artificial Sequence
  Synthetically generated peptide
CCYYCCNPACTGC

SEQ ID NO: 1891 - protein, 13 aa, Artificial Sequence
  Synthetically generated peptide
CCDYCCNPACTGC

SEQ ID NO: 1892 - protein, 13 aa, Artificial Sequence
  Synthetically generated peptide
CCKYCCNPACTGC

SEQ ID NO: 1893 - protein, 13 aa, Artificial Sequence
  Synthetically generated peptide
CCRYCCNPACTGC

SEQ ID NO: 1894 - protein, 13 aa, Artificial Sequence
  Synthetically generated peptide
CCHYCCNPACTGC

SEQ ID NO: 1895 - protein, 14 aa, Artificial Sequence
  Synthetically generated peptide
CCEFCCAPACTGCY

SEQ ID NO: 1896 - protein, 14 aa, Artificial Sequence
  Synthetically generated peptide
CCEFCCVPACTGCY

SEQ ID NO: 1897 - protein, 14 aa, Artificial Sequence
  Synthetically generated peptide
CCEFCCLPACTGCY

SEQ ID NO: 1898 - protein, 14 aa, Artificial Sequence
  Synthetically generated peptide
CCEFCCIPACTGCY

SEQ ID NO: 1899 - protein, 14 aa, Artificial Sequence
  Synthetically generated peptide
CCEFCCPPACTGCY

SEQ ID NO: 1900 - protein, 14 aa, Artificial Sequence
  Synthetically generated peptide
CCEFCCMPACTGCY

SEQ ID NO: 1901 - protein, 14 aa, Artificial Sequence
  Synthetically generated peptide
CCEFCCFPACTGCY

SEQ ID NO: 1902 - protein, 14 aa, Artificial Sequence
  Synthetically generated peptide
CCEFCCWPACTGCY

SEQ ID NO: 1903 - protein, 14 aa, Artificial Sequence
  Synthetically generated peptide
CCEFCCGPACTGCY

SEQ ID NO: 1904 - protein, 14 aa, Artificial Sequence
  Synthetically generated peptide
CCEFCCSPACTGCY

SEQ ID NO: 1905 - protein, 14 aa, Artificial Sequence
  Synthetically generated peptide
CCEFCCTPACTGCY

SEQ ID NO: 1906 - protein, 14 aa, Artificial Sequence
  Synthetically generated peptide
CCEFCCCPACTGCY

SEQ ID NO: 1907 - protein, 14 aa, Artificial Sequence
  Synthetically generated peptide
CCEFCCQPACTGCY

SEQ ID NO: 1908 - protein, 14 aa, Artificial Sequence
  Synthetically generated peptide
CCEFCCYPACTGCY

SEQ ID NO: 1909 - protein, 14 aa, Artificial Sequence
  Synthetically generated peptide
CCEFCCDPACTGCY

SEQ ID NO: 1910 - protein, 14 aa, Artificial Sequence
  Synthetically generated peptide
CCEFCCEPACTGCY

SEQ ID NO: 1911 - protein, 14 aa, Artificial Sequence
  Synthetically generated peptide
CCEFCCKPACTGCY

SEQ ID NO: 1912 - protein, 14 aa, Artificial Sequence
  Synthetically generated peptide
CCEFCCRPACTGCY

SEQ ID NO: 1913 - protein, 14 aa, Artificial Sequence
  Synthetically generated peptide
CCEFCCHPACTGCY

SEQ ID NO: 1914 - protein, 13 aa, Artificial Sequence
  Synthetically generated peptide
CCEFCCAPACTGC

SEQ ID NO: 1915 - protein, 13 aa, Artificial Sequence
  Synthetically generated peptide
CCEFCCVPACTGC

SEQ ID NO: 1916 - protein, 13 aa, Artificial Sequence
  Synthetically generated peptide
CCEFCCLPACTGC

SEQ ID NO: 1917 - protein, 13 aa, Artificial Sequence
  Synthetically generated peptide
CCEFCCIPACTGC

SEQ ID NO: 1918 - protein, 13 aa, Artificial Sequence
  Synthetically generated peptide
CCEFCCPPACTGC

SEQ ID NO: 1919 - protein, 13 aa, Artificial Sequence
  Synthetically generated peptide
CCEFCCMPACTGC

SEQ ID NO: 1920 - protein, 13 aa, Artificial Sequence
  Synthetically generated peptide
CCEFCCFPACTGC

SEQ ID NO: 1921 - protein, 13 aa, Artificial Sequence
  Synthetically generated peptide
CCEFCCWPACTGC

SEQ ID NO: 1922 - protein, 13 aa, Artificial Sequence
  Synthetically generated peptide
CCEFCCGPACTGC

SEQ ID NO: 1923 - protein, 13 aa, Artificial Sequence
  Synthetically generated peptide
CCEFCCSPACTGC

SEQ ID NO: 1924 - protein, 13 aa, Artificial Sequence
  Synthetically generated peptide
CCEFCCTPACTGC

SEQ ID NO: 1925 - protein, 13 aa, Artificial Sequence
  Synthetically generated peptide
CCEFCCCPACTGC

SEQ ID NO: 1926 - protein, 13 aa, Artificial Sequence
  Synthetically generated peptide
CCEFCCQPACTGC

SEQ ID NO: 1927 - protein, 13 aa, Artificial Sequence
  Synthetically generated peptide
CCEFCCYPACTGC

SEQ ID NO: 1928 - protein, 13 aa, Artificial Sequence
  Synthetically generated peptide
CCEFCCDPACTGC

SEQ ID NO: 1929 - protein, 13 aa, Artificial Sequence
  Synthetically generated peptide
CCEFCCEPACTGC

SEQ ID NO: 1930 - protein, 13 aa, Artificial Sequence
  Synthetically generated peptide
CCEFCCKPACTGC

SEQ ID NO: 1931 - protein, 13 aa, Artificial Sequence
  Synthetically generated peptide
CCEFCCRPACTGC

SEQ ID NO: 1932 - protein, 13 aa, Artificial Sequence
  Synthetically generated peptide
CCEFCCHPACTGC

SEQ ID NO: 1933 - protein, 14 aa, Artificial Sequence
  Synthetically generated peptide
CCEWCCAPACTGCY

SEQ ID NO: 1934 - protein, 14 aa, Artificial Sequence
  Synthetically generated peptide
CCEWCCVPACTGCY

SEQ ID NO: 1935 - protein, 14 aa, Artificial Sequence
  Synthetically generated peptide
CCEWCCLPACTGCY

SEQ ID NO: 1936 - protein, 14 aa, Artificial Sequence
  Synthetically generated peptide
CCEWCCIPACTGCY

SEQ ID NO: 1937 - protein, 14 aa, Artificial Sequence
  Synthetically generated peptide
CCEWCCPPACTGCY

SEQ ID NO: 1938 - protein, 14 aa, Artificial Sequence
  Synthetically generated peptide
CCEWCCMPACTGCY

SEQ ID NO: 1939 - protein, 14 aa, Artificial Sequence
  Synthetically generated peptide
CCEWCCFPACTGCY

SEQ ID NO: 1940 - protein, 14 aa, Artificial Sequence
  Synthetically generated peptide
CCEWCCWPACTGCY

SEQ ID NO: 1941 - protein, 14 aa, Artificial Sequence
  Synthetically generated peptide
CCEWCCGPACTGCY

SEQ ID NO: 1942 - protein, 14 aa, Artificial Sequence
  Synthetically generated peptide
CCEWCCSPACTGCY

SEQ ID NO: 1943 - protein, 14 aa, Artificial Sequence
  Synthetically generated peptide
CCEWCCTPACTGCY

SEQ ID NO: 1944 - protein, 14 aa, Artificial Sequence
  Synthetically generated peptide
CCEWCCCPACTGCY

SEQ ID NO: 1945 - protein, 14 aa, Artificial Sequence
  Synthetically generated peptide
CCEWCCQPACTGCY

SEQ ID NO: 1946 - protein, 14 aa, Artificial Sequence
  Synthetically generated peptide
CCEWCCYPACTGCY

SEQ ID NO: 1947 - protein, 14 aa, Artificial Sequence
  Synthetically generated peptide
CCEWCCDPACTGCY

SEQ ID NO: 1948 - protein, 14 aa, Artificial Sequence
  Synthetically generated peptide
CCEWCCEPACTGCY

SEQ ID NO: 1949 - protein, 14 aa, Artificial Sequence
  Synthetically generated peptide
CCEWCCKPACTGCY

SEQ ID NO: 1950 - protein, 14 aa, Artificial Sequence
  Synthetically generated peptide
CCEWCCRPACTGCY

SEQ ID NO: 1951 - protein, 14 aa, Artificial Sequence
  Synthetically generated peptide
CCEWCCHPACTGCY

SEQ ID NO: 1952 - protein, 13 aa, Artificial Sequence
  Synthetically generated peptide
CCEWCCAPACTGC

SEQ ID NO: 1953 - protein, 13 aa, Artificial Sequence
  Synthetically generated peptide
CCEWCCVPACTGC

SEQ ID NO: 1954 - protein, 13 aa, Artificial Sequence
  Synthetically generated peptide
CCEWCCLPACTGC

SEQ ID NO: 1955 - protein, 13 aa, Artificial Sequence
  Synthetically generated peptide
CCEWCCIPACTGC

SEQ ID NO: 1956 - protein, 13 aa, Artificial Sequence
  Synthetically generated peptide
CCEWCCPPACTGC

SEQ ID NO: 1957 - protein, 13 aa, Artificial Sequence
  Synthetically generated peptide
CCEWCCMPACTGC

SEQ ID NO: 1958 - protein, 13 aa, Artificial Sequence
  Synthetically generated peptide
CCEWCCFPACTGC

SEQ ID NO: 1959 - protein, 13 aa, Artificial Sequence
  Synthetically generated peptide
CCEWCCWPACTGC

SEQ ID NO: 1960 - protein, 13 aa, Artificial Sequence
  Synthetically generated peptide
CCEWCCGPACTGC

SEQ ID NO: 1961 - protein, 13 aa, Artificial Sequence
  Synthetically generated peptide
CCEWCCSPACTGC

SEQ ID NO: 1962 - protein, 13 aa, Artificial Sequence
  Synthetically generated peptide
CCEWCCTPACTGC

SEQ ID NO: 1963 - protein, 13 aa, Artificial Sequence
  Synthetically generated peptide
CCEWCCCPACTGC

SEQ ID NO: 1964 - protein, 13 aa, Artificial Sequence
  Synthetically generated peptide
CCEWCCQPACTGC

SEQ ID NO: 1965 - protein, 13 aa, Artificial Sequence
  Synthetically generated peptide
CCEWCCYPACTGC

SEQ ID NO: 1966 - protein, 13 aa, Artificial Sequence
  Synthetically generated peptide
CCEWCCDPACTGC

SEQ ID NO: 1967 - protein, 13 aa, Artificial Sequence
  Synthetically generated peptide
CCEWCCEPACTGC

SEQ ID NO: 1968 - protein, 13 aa, Artificial Sequence
  Synthetically generated peptide
CCEWCCKPACTGC

SEQ ID NO: 1969 - protein, 13 aa, Artificial Sequence
  Synthetically generated peptide
CCEWCCRPACTGC

SEQ ID NO: 1970 - protein, 13 aa, Artificial Sequence
  Synthetically generated peptide
CCEWCCHPACTGC

SEQ ID NO: 1971 - protein, 14 aa, Artificial Sequence
  Synthetically generated peptide
CCEWCCNPACTGCA

SEQ ID NO: 1972 - protein, 14 aa, Artificial Sequence
  Synthetically generated peptide
CCEWCCNPACTGCV

SEQ ID NO: 1973 - protein, 14 aa, Artificial Sequence
  Synthetically generated peptide
CCEWCCNPACTGCL

SEQ ID NO: 1974 - protein, 14 aa, Artificial Sequence
  Synthetically generated peptide
CCEWCCNPACTGCI

SEQ ID NO: 1975 - protein, 14 aa, Artificial Sequence
  Synthetically generated peptide
CCEWCCNPACTGCP

SEQ ID NO: 1976 - protein, 14 aa, Artificial Sequence
  Synthetically generated peptide
CCEWCCNPACTGCM

SEQ ID NO: 1977 - protein, 14 aa, Artificial Sequence
  Synthetically generated peptide
CCEWCCNPACTGCF

SEQ ID NO: 1978 - protein, 14 aa, Artificial Sequence
  Synthetically generated peptide
CCEWCCNPACTGCW

SEQ ID NO: 1979 - protein, 14 aa, Artificial Sequence
  Synthetically generated peptide
CCEWCCNPACTGCG

SEQ ID NO: 1980 - protein, 14 aa, Artificial Sequence
  Synthetically generated peptide
CCEWCCNPACTGCS

SEQ ID NO: 1981 - protein, 14 aa, Artificial Sequence
  Synthetically generated peptide
CCEWCCNPACTGCT

SEQ ID NO: 1982 - protein, 14 aa, Artificial Sequence
  Synthetically generated peptide
CCEWCCNPACTGCC

SEQ ID NO: 1983 - protein, 14 aa, Artificial Sequence
  Synthetically generated peptide
CCEWCCNPACTGCN

SEQ ID NO: 1984 - protein, 14 aa, Artificial Sequence
  Synthetically generated peptide
CCEWCCNPACTGCQ

SEQ ID NO: 1985 - protein, 14 aa, Artificial Sequence
  Synthetically generated peptide
CCEWCCNPACTGCD

SEQ ID NO: 1986 - protein, 14 aa, Artificial Sequence
  Synthetically generated peptide
CCEWCCNPACTGCE

SEQ ID NO: 1987 - protein, 14 aa, Artificial Sequence
  Synthetically generated peptide
CCEWCCNPACTGCK

SEQ ID NO: 1988 - protein, 14 aa, Artificial Sequence
  Synthetically generated peptide
CCEWCCNPACTGCR

SEQ ID NO: 1989 - protein, 14 aa, Artificial Sequence
  Synthetically generated peptide
CCEWCCNPACTGCH

SEQ ID NO: 1990 - protein, 14 aa, Artificial Sequence
  Synthetically generated peptide
CCEFCCNPACTGCA

SEQ ID NO: 1991 - protein, 14 aa, Artificial Sequence
  Synthetically generated peptide
CCEFCCNPACTGCV

SEQ ID NO: 1992 - protein, 14 aa, Artificial Sequence
  Synthetically generated peptide
CCEFCCNPACTGCL

SEQ ID NO: 1993 - protein, 14 aa, Artificial Sequence
  Synthetically generated peptide
CCEFCCNPACTGCI

SEQ ID NO: 1994 - protein, 14 aa, Artificial Sequence
  Synthetically generated peptide
CCEFCCNPACTGCP

SEQ ID NO: 1995 - protein, 14 aa, Artificial Sequence
  Synthetically generated peptide
CCEFCCNPACTGCM

SEQ ID NO: 1996 - protein, 14 aa, Artificial Sequence
  Synthetically generated peptide
CCEFCCNPACTGCF

SEQ ID NO: 1997 - protein, 14 aa, Artificial Sequence
  Synthetically generated peptide
CCEFCCNPACTGCW

SEQ ID NO: 1998 - protein, 14 aa, Artificial Sequence
  Synthetically generated peptide
CCEFCCNPACTGCG

SEQ ID NO: 1999 - protein, 14 aa, Artificial Sequence
  Synthetically generated peptide
CCEFCCNPACTGCS

SEQ ID NO: 2000 - protein, 14 aa, Artificial Sequence
  Synthetically generated peptide
CCEFCCNPACTGCT

SEQ ID NO: 2001 - protein, 14 aa, Artificial Sequence
  Synthetically generated peptide
CCEFCCNPACTGCC

SEQ ID NO: 2002 - protein, 14 aa, Artificial Sequence
  Synthetically generated peptide
CCEFCCNPACTGCN

SEQ ID NO: 2003 - protein, 14 aa, Artificial Sequence
  Synthetically generated peptide
CCEFCCNPACTGCQ

SEQ ID NO: 2004 - protein, 14 aa, Artificial Sequence
  Synthetically generated peptide
CCEFCCNPACTGCD

SEQ ID NO: 2005 - protein, 14 aa, Artificial Sequence
  Synthetically generated peptide
CCEFCCNPACTGCE

SEQ ID NO: 2006 - protein, 14 aa, Artificial Sequence
  Synthetically generated peptide
CCEFCCNPACTGCK

SEQ ID NO: 2007 - protein, 14 aa, Artificial Sequence
  Synthetically generated peptide
CCEFCCNPACTGCR

SEQ ID NO: 2008 - protein, 14 aa, Artificial Sequence
  Synthetically generated peptide
CCEFCCNPACTGCH

SEQ ID NO: 2009 - protein, 14 aa, Artificial Sequence
  Synthetically generated peptide
CCAFCCNPACTGCY

SEQ ID NO: 2010 - protein, 14 aa, Artificial Sequence
  Synthetically generated peptide
CCVFCCNPACTGCY

SEQ ID NO: 2011 - protein, 14 aa, Artificial Sequence
  Synthetically generated peptide
CCLFCCNPACTGCY

SEQ ID NO: 2012 - protein, 14 aa, Artificial Sequence
  Synthetically generated peptide
CCIFCCNPACTGCY

SEQ ID NO: 2013 - protein, 14 aa, Artificial Sequence
  Synthetically generated peptide
CCMFCCNPACTGCY

SEQ ID NO: 2014 - protein, 14 aa, Artificial Sequence
  Synthetically generated peptide
CCFFCCNPACTGCY

SEQ ID NO: 2015 - protein, 14 aa, Artificial Sequence
  Synthetically generated peptide
CCWFCCNPACTGCY

SEQ ID NO: 2016 - protein, 14 aa, Artificial Sequence
  Synthetically generated peptide
CCGFCCNPACTGCY

SEQ ID NO: 2017 - protein, 14 aa, Artificial Sequence
  Synthetically generated peptide
CCSFCCNPACTGCY

SEQ ID NO: 2018 - protein, 14 aa, Artificial Sequence
  Synthetically generated peptide
CCTFCCNPACTGCY

SEQ ID NO: 2019 - protein, 14 aa, Artificial Sequence
  Synthetically generated peptide
CCCFCCNPACTGCY

SEQ ID NO: 2020 - protein, 14 aa, Artificial Sequence
  Synthetically generated peptide
CCNFCCNPACTGCY

SEQ ID NO: 2021 - protein, 14 aa, Artificial Sequence
  Synthetically generated peptide
CCQFCCNPACTGCY

SEQ ID NO: 2022 - protein, 14 aa, Artificial Sequence
  Synthetically generated peptide
CCYFCCNPACTGCY

SEQ ID NO: 2023 - protein, 14 aa, Artificial Sequence
  Synthetically generated peptide
CCDFCCNPACTGCY

SEQ ID NO: 2024 - protein, 14 aa, Artificial Sequence
  Synthetically generated peptide
CCKFCCNPACTGCY

SEQ ID NO: 2025 - protein, 14 aa, Artificial Sequence
  Synthetically generated peptide
CCRFCCNPACTGCY

SEQ ID NO: 2026 - protein, 14 aa, Artificial Sequence
  Synthetically generated peptide
CCHFCCNPACTGCY

SEQ ID NO: 2027 - protein, 13 aa, Artificial Sequence
  Synthetically generated peptide
CCAFCCNPACTGC

SEQ ID NO: 2028 - protein, 13 aa, Artificial Sequence
  Synthetically generated peptide
CCVFCCNPACTGC

SEQ ID NO: 2029 - protein, 13 aa, Artificial Sequence
  Synthetically generated peptide
CCLFCCNPACTGC

SEQ ID NO: 2030 - protein, 13 aa, Artificial Sequence
  Synthetically generated peptide
CCIFCCNPACTGC

SEQ ID NO: 2031 - protein, 13 aa, Artificial Sequence
  Synthetically generated peptide
CCMFCCNPACTGC

SEQ ID NO: 2032 - protein, 13 aa, Artificial Sequence
  Synthetically generated peptide
CCFFCCNPACTGC

SEQ ID NO: 2033 - protein, 13 aa, Artificial Sequence
  Synthetically generated peptide
CCWFCCNPACTGC

SEQ ID NO: 2034 - protein, 13 aa, Artificial Sequence
  Synthetically generated peptide
CCGFCCNPACTGC

SEQ ID NO: 2035 - protein, 13 aa, Artificial Sequence
  Synthetically generated peptide
CCSFCCNPACTGC

SEQ ID NO: 2036 - protein, 13 aa, Artificial Sequence
  Synthetically generated peptide
CCTFCCNPACTGC

SEQ ID NO: 2037 - protein, 13 aa, Artificial Sequence
  Synthetically generated peptide
CCCFCCNPACTGC

SEQ ID NO: 2038 - protein, 13 aa, Artificial Sequence
  Synthetically generated peptide
CCNFCCNPACTGC

SEQ ID NO: 2039 - protein, 13 aa, Artificial Sequence
  Synthetically generated peptide
CCQFCCNPACTGC

SEQ ID NO: 2040 - protein, 13 aa, Artificial Sequence
  Synthetically generated peptide
CCYFCCNPACTGC

SEQ ID NO: 2041 - protein, 13 aa, Artificial Sequence
  Synthetically generated peptide
CCDFCCNPACTGC

SEQ ID NO: 2042 - protein, 13 aa, Artificial Sequence
  Synthetically generated peptide
CCKFCCNPACTGC

SEQ ID NO: 2043 - protein, 13 aa, Artificial Sequence
  Synthetically generated peptide
CCRFCCNPACTGC

SEQ ID NO: 2044 - protein, 13 aa, Artificial Sequence
  Synthetically generated peptide
CCHFCCNPACTGC

SEQ ID NO: 2045 - protein, 14 aa, Artificial Sequence
  Synthetically generated peptide
CCAWCCNPACTGCY

SEQ ID NO: 2046 - protein, 14 aa, Artificial Sequence
  Synthetically generated peptide
CCVWCCNPACTGCY

SEQ ID NO: 2047 - protein, 14 aa, Artificial Sequence
  Synthetically generated peptide
CCLWCCNPACTGCY

SEQ ID NO: 2048 - protein, 14 aa, Artificial Sequence
  Synthetically generated peptide
CCIWCCNPACTGCY

SEQ ID NO: 2049 - protein, 14 aa, Artificial Sequence
  Synthetically generated peptide
CCMWCCNPACTGCY

SEQ ID NO: 2050 - protein, 14 aa, Artificial Sequence
  Synthetically generated peptide
CCFWCCNPACTGCY

SEQ ID NO: 2051 - protein, 14 aa, Artificial Sequence
  Synthetically generated peptide
CCWWCCNPACTGCY

SEQ ID NO: 2052 - protein, 14 aa, Artificial Sequence
  Synthetically generated peptide
CCGWCCNPACTGCY

SEQ ID NO: 2053 - protein, 14 aa, Artificial Sequence
  Synthetically generated peptide
CCSWCCNPACTGCY

SEQ ID NO: 2054 - protein, 14 aa, Artificial Sequence
  Synthetically generated peptide
CCTWCCNPACTGCY

SEQ ID NO: 2055 - protein, 14 aa, Artificial Sequence
  Synthetically generated peptide
CCCWCCNPACTGCY

SEQ ID NO: 2056 - protein, 14 aa, Artificial Sequence
  Synthetically generated peptide
CCNWCCNPACTGCY

SEQ ID NO: 2057 - protein, 14 aa, Artificial Sequence
  Synthetically generated peptide
CCQWCCNPACTGCY

SEQ ID NO: 2058 - protein, 14 aa, Artificial Sequence
  Synthetically generated peptide
CCYWCCNPACTGCY

SEQ ID NO: 2059 - protein, 14 aa, Artificial Sequence
  Synthetically generated peptide
CCDWCCNPACTGCY

SEQ ID NO: 2060 - protein, 14 aa, Artificial Sequence
  Synthetically generated peptide
CCKWCCNPACTGCY

SEQ ID NO: 2061 - protein, 14 aa, Artificial Sequence
  Synthetically generated peptide
CCRWCCNPACTGCY

SEQ ID NO: 2062 - protein, 14 aa, Artificial Sequence
  Synthetically generated peptide
CCHWCCNPACTGCY

SEQ ID NO: 2063 - protein, 13 aa, Artificial Sequence
  Synthetically generated peptide
CCAWCCNPACTGC

SEQ ID NO: 2064 - protein, 13 aa, Artificial Sequence
  Synthetically generated peptide
CCVWCCNPACTGC

SEQ ID NO: 2065 - protein, 13 aa, Artificial Sequence
  Synthetically generated peptide
CCLWCCNPACTGC

SEQ ID NO: 2066 - protein, 13 aa, Artificial Sequence
  Synthetically generated peptide
CCIWCCNPACTGC

SEQ ID NO: 2067 - protein, 13 aa, Artificial Sequence
  Synthetically generated peptide
CCMWCCNPACTGC

SEQ ID NO: 2068 - protein, 13 aa, Artificial Sequence
  Synthetically generated peptide
CCFWCCNPACTGC

SEQ ID NO: 2069 - protein, 13 aa, Artificial Sequence
  Synthetically generated peptide
CCWWCCNPACTGC

SEQ ID NO: 2070 - protein, 13 aa, Artificial Sequence
  Synthetically generated peptide
CCGWCCNPACTGC

SEQ ID NO: 2071 - protein, 13 aa, Artificial Sequence
  Synthetically generated peptide
CCSWCCNPACTGC

SEQ ID NO: 2072 - protein, 13 aa, Artificial Sequence
  Synthetically generated peptide
CCTWCCNPACTGC

SEQ ID NO: 2073 - protein, 13 aa, Artificial Sequence
  Synthetically generated peptide
CCCWCCNPACTGC

SEQ ID NO: 2074 - protein, 13 aa, Artificial Sequence
  Synthetically generated peptide
CCNWCCNPACTGC

SEQ ID NO: 2075 - protein, 13 aa, Artificial Sequence
  Synthetically generated peptide
CCQWCCNPACTGC

SEQ ID NO: 2076 - protein, 13 aa, Artificial Sequence
  Synthetically generated peptide
CCYWCCNPACTGC

SEQ ID NO: 2077 - protein, 13 aa, Artificial Sequence
  Synthetically generated peptide
CCDWCCNPACTGC

SEQ ID NO: 2078 - protein, 13 aa, Artificial Sequence
  Synthetically generated peptide
CCKWCCNPACTGC

SEQ ID NO: 2079 - protein, 13 aa, Artificial Sequence
  Synthetically generated peptide
CCRWCCNPACTGC

SEQ ID NO: 2080 - protein, 13 aa, Artificial Sequence
  Synthetically generated peptide
CCHWCCNPACTGC

SEQ ID NO: 2081 - protein, 20 aa, Artificial Sequence
  Synthetically generated peptide
GNLIDCCEICCNPACFGCLN

SEQ ID NO: 2082 - protein, 20 aa, Artificial Sequence
  Synthetically generated peptide
GNLIDRCEICCNPACFGCLN

SEQ ID NO: 2083 - protein, 23 aa, Artificial Sequence
  Synthetically generated peptide
PPAEVSSDWDCCDVCCNPACAGC

SEQ ID NO: 2084 - protein, 65 aa, Artificial Sequence
  Synthetically generated peptide
  VARIANT 2-5, 7-10, 12-15, 17-20, 22-25, 27-30, 32-35, 37-40, 42-45,47-50, 52-55, 57-60, 62-65: Xaa = any amino acid (natural or non-natural), the same or diferent
CXXXXEXXXXYXXXXCXXXXCXXXXNXXXXPXXXXAXXXXCXXXXTXXXXGXXXXCXXXXYXXXX

What is claimed is:

1. A nucleic acid molecule encoding the peptide consisting of the amino acid sequence of SEQ ID NO:3.

2. A vector comprising the nucleic acid molecule of claim 1.

3. An isolated cell comprising the vector of claim 2.

4. An isolated cell comprising the nucleic acid molecule of claim 1.

5. A method of recombinantly producing a peptide consisting of the amino acid sequence of SEQ ID NO:3, comprising expressing the vector of claim 2 in a cell.

6. The method according to claim 5, further comprising recovering the peptide.

7. The peptide produced by the method of claim 6.

8. A method of recombinantly producing a peptide consisting of the amino acid sequence of SEQ ID NO:3, comprising culturing the cell of claim 3 and expressing the peptide.

9. The method according to claim 8, further comprising recovering the peptide.

10. The peptide produced by the method of claim 9.

* * * * *